United States Patent 10,407,724 (METHODS AND COMPOSITIONS FOR SCREENING AND TREATING DEVELOPMENTAL DISORDERS) - sequence listing, part 14

SEQ ID NO: 256 - DNA, 95447 bp, Homo sapiens
ctacaaagttgattataactgtttgaaacatgcatcctttcacacatcataagaccagtgcacaaaaagagtgcacttcatgcctgtatattttaaagaatagaatgaacactgggtacccgctagctcacttgaggcatagatcatcaccaggtacctagaggcctcctctgggcttaccctggtctctttgcctcagaggttgtcactgatgtgaaagctgcccatcttgatcctgtagtcagccatgagggcttgtggccttaaatgctgcctttttttcttgtctttgatgtttatgtaaatgatgtctttgtgtactttgggactttcttgctcaacactgttattgaaatttacctgtgtagtggcaggaagttgtacttcattctttttcactgctatgtgttgtgtctttggtataactgctacacaactgattgaggcaatggtactgctttgaacatcctcgtgcctattttctggtgcaaaagtgtgagagtttcaaggtgcctgggagtggggttgttgggtctgaaggtatgcacatttttaactttacaaggtgctgccaaattgtttccaaagtggtcacacccatttcccaagttccatagtgggtgccccacattatccccagtgcttgataattttgtacgcacccttttcaggttagaaaatctctctggggccgggcacggtggctcacttctgtaatcccagcactttgggaggccgagacgggtgtaggtcaggagatcgagaccatcctggctaacacggtgaaaccttgtctctactaaaaatacaaaaaattagccgggcgtagtggtgggctcctgtagtcccagctactcgggaggctgaggcaggagatggcatgagaggcggagcttgcagtgagccgagatcgtgccactgcactccagcccaggcgactgagcaagactctgtctcaaaaaaaaaataagaaaatctctcacgtcaccctccagggtaatagctgtccattacttattccttagttggcaaagtctatagtaacaaggtgctgtggattcagtagcacctttccccccgttctagtgccactgcattatttatttatttatttatttatttatttatttctatttttttttttgagacaaagtctcgctctgtcacccaggctggagtgcagtggcgtgatctcagctcactgcaacctccacctcctgggttccagcaattctcctgcctcagcctcccaagtagctgggactacaggtgcacgccaccacgtccggctaatttttgtattttttttgtagagacggggtttcaccatattcaccaggctggtttcgaactcctgacctcgtgatctgcccgccttggcctcccaaagtgctgggattacaggcgcaagccactgcacccagccgccagtgcattttttaaaaaaacgtttttattttgaagtaattatagatccacaggaagtagggggcaatacacagggacatcctgtgtattcattacccagcatcctccatcttgcttaactatagtacaataacacagactgaaaattctcggtgccacagccacagaggtccttcagacagcaccagttgtgcatgtagtgagtgtgagtgtgtgtgtgtgtgtgtgtgtgtgtttgtgtttgtgaatgcagtcttaccatgggtagctttgtggaaccaccaccacagtcaggacacagaattgctccttcactgcaaggcaccctcatgcttcctttcatagctacactgacatccttcccacccaatctgcaaccccttgtgtctttgtccactttgtgctgctgtaacacctgagactaggttgtttataaagaatagaagaaatttattctctaacagctctagaggctgtaagtccaaatcatggcaccagcatttggtctggtgagggccttcttgctgtgtcctcacatggcataaggcagaaggacaaaaaggaatgaactttccttcagaaggccaggaaagaggttaacccactcccacaagcctttttatagcgacatgaattcattcctgatggtggatccctcacaacctaaacactttcccaaagaccccaccacccaacactgttgcactggggaataagtttccaacacatgaattttggagggacaaaaacattcaagccacagcactggcaaccactgatctgtcccctgtctttctaattattatttcaagaatgtcatataaatggaatctatggtatataaccttttgagttttgtttaacctaccatgattcccctgagatccatccaggttgttttgtatattaatatgttattcctttttattgctgggcagtatcccatggtatagaggtaccagagtttatttgttgaaggacatttggatgatttccaggttggggctattatacataaaactcgctatgtacattcatgtataggtttttgtgtgaacagagttttaatttctctgggataattgcacttacaaatgcagttgttggtttgcatggtagttgcagatatactcttataagagactgtcaaactgttttccaaagtggctgtaccattttactagtaggacttttaaagtagcgtgtgtgtgtgtgtatgtattttttttgaggtatggtctgggtctgctgcccaggttggagtgcagtggcttgatcacagatcactgcaacttctacctcctggctaaagcaatcctcctgcctcagcctcccaagtagctaggactacaggtgcgtacctccatgcatggctaatttttgcttttctgtttttgtagagactgggtttcgtcatgttgctcaggctggtcttgaacccctgagctcaagcaatcctcccacctcagcctcccaaagtgctgggactacaggcatgagccaccacgcctggcctttatatgtatatttttgatcatagtaacatcagtatgcaattaaagagtaataatatgtatgtaaaataaagacacgaatatttattcaactctagacaacgtttgatgccataatgggtttaaaataactctgggagcctgggaatctagtctctagattggaaaccactgaactgggtattttattattaaaaacaataatcattattattttttccattgtaataacatgtaaaaaaacatatttcccatatgctcagtggagaaaatttggaaataaggaaagtagcaagaagaagtggggggaaagaggcacccataattctattacccagagtcaaaaacatcttttaacactttttctgtgcattaaaaacaaaaaaagaaaattatacctccatcatttctggtgtgacctgcattgtgacagcacaatgttggccagttatggtgcagaaaacagtgctacccctgggagcctggagtgtggtgggagatagctccaatagtggcaggtgctgtgcaggaagaggctcgtgtgaaagtactggagggctgccatggggcacggtgatggggacatggggccatgccgtctgcacaaggccaagtggaagagcagatttttcacggtaaatgtaggcagaccctttttttttcctggttgtctaacctattattgtagaagtgctcatatacattcttttccatctgtgctttggcaggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtaacagggtctgggtgtgtgtgggtacagctgcctgggcttttggcacatcttgatctttagttacagagagtcaggacaagactgagatcttttgtggctgagaaacgattcaagggctgggtgcagtggttcacgcctgtaatcccagcactttgggaggccgaggcaggtggattacctgaggtcaggagttggagaccagcctggccaacagggtgaaaccccgtctctactaaaaatacaaaaattagccgggcgtggtggcacacacctgtaatcccagctacttgggaggctgaggcaagagaatcactggaacccagagggcagtggctgcagtgagccgagattgtgccactgcattccagcctgggtgacagaatgagactcttgtctcaaataataataataataataataataataataatgtgtacaactcattggtttttagaatgttcagagttgtgcagtcattaccatagttggttttagaacattttcttcttcctagaaaggaaccccatacccattagctgtcacttcacattttctctcactgccattagtccctgggaaccactaatctgctttctgtctctctagatttgcctgttctggacatttcatataaatgagattatacaatgtgtggtcttttgtgtctggctgtcttcactcaacataatattttcaaggttcatccatgttggagcatgaatcaatacttcattttatgatcaaataatgctgtgttacatggatagtccacattttgtctctctcttcgtatttcatgttgatagaaaaaattttttttctactttttaacttatgaatggtgctgcagtaaacatttgtgtacaagtttttgtgtggacatgtgttttctcttctcttggatacgtacctaggtttagaactgccaggtcatacagtaacttcatgtttaaactttcaaggagctgccagactgtttttcaaagcagctgcgccattttacattcccacagccgtgagttgggggggggctccagtttctctgcatccctccagtacttgttattatcttttttgccatacctatcctagtgggtgtgaggttatcaaatcttaacctaagaaacacaggctgggcgcggtggctcacgcctgtaatcccagcactttgggaggccgaggccggtggatcatgaggtcaggaggtcgagaccatcctggctaacgcggtgaaaccccgtctctactaaaaatacaaaaaaattacttgagcgtggtggcgggcgcctgtcgtcccagcttacttgggaggctgaagcaggagaatggcatgaacccaggaggcagagcttgcagtgagctgagatggcatcactgcactccaggctgagcgacagagcaagactccgtctaaaaataaataaataaataaataattgaaacattgacttgagacatagatccactgtgttttcctgtcgtggcaagcctcagatttgagaagctgtcacatttccagatcaaaccatgaagctacttggctttctgatgctgtggttttttttcttttgcttcacaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatctacacgctgtgaatgttgaaatgttcatcagcttgttttctcttctgcagctttgtgggggatgcagtagcctctcagagatgtgatatcctctgttctgacaatttgtccaaggccctgaaagttcccgatgtgtagtcatttgattgaggagggggaggagctggaatctcagcatgcaaggccacaggcagcagagaagccagtggtcaccatctgccattggtcttggtgtggctttgcctctcttccgtggctggctgttctccatcatgctctagggagatgagatgctgggggatgcatcccaaagggcaagtgacatgacccttgttgctgtcaagggtctaatatcatctgtcttttttttttttttttttttttttttgagacggagtctcgctctgtcgcccaggctggagtgcagtggcaggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcaatctcctgacctcgtgatccgcccgcctcggcctcccaaagtgctgggattacaggcgtgagccactgcgcccggcctcatctgtctttagagtttaggaccctgagcttccccagagtccattggagtggcctcccctggagcactggcactggggtttacacacccctgtcctcccactcagcctgacttatggaggaatatgtagacttgctcataaaaactaatttttcttcctccccaaacaccttaaacctttgctttctgcttgtctgtgttagaatctggaataaaatagtttatttagcacaaaattaggatcagtcaccagccacgctggccttctctgtgctccacagagagcagcgtggcccgagggcttgccccagtaggccagggccttgtttgtgcagaagcaccaagggctctgcttctggaagctgcccaagtgttccgtgggctcttgcacactcagcagtgccacccctcacacctagtttacttgaggaaacagctttgagggaaaggtgttcattctctccccaagtttccaaatccagttaatgatagagctatttactttgaagaagtgtccttgctttctgtgaacctgtccctagaaatggggcctctcgatcttcggaatgaattggcttagggcatgggatggtagctggtggcttctttgccagtgcagctctgtcagttgcaggctggagaccacccagtttccacatttggaagaagagctttgggagcaaggtgtcaccacccatgagagtggagcctgcctgtggtgccaggacctcccactgttgctgtgaaatgagctgaagaggcttcagtaaatctcacagctccagcctctgatgggtttgggttttttcttaccttctgccgtttggatgctgcctaaccatttgctactatagatgacggttgaagttgccatgtggtttggctttataacaagtgacaggcacttcctgaacagccatggggcatcccctggggtggctgtgctggcacagtggccctcccatggtttgggaatggtggtgctgcactagcacggaggacaggttctgctctgggttccttggagatgcagtgggctctcaagctccttcagtgggaggtttcctcctgccactgtgtccagtgagctttgacctctggtttttcttggcatgtcatccttcatgaagaaaagtcatatttacagaagtgaatggaaacatgttttatgggagtgttttcctctgggtaatgaacttggctaaagctaggatccttcacacccacagagactcgaaggtctgccctgagttggctctggaagaacatgaagatgagtgctgggaggagccacgggtggggcatgtgccaggggatggctgacagggctgaggcccaggaaagacaactggcagatgatggtggaggagagtggagtgccacgtcctggcccgccgggctggggcaggaggatggaagccttcaaggggcaagtcaggttctgtggtgtggtggggagtgctgggggactctcagggcttcaggagtgcccagtaaggacacccaaacccctcagccatcctcttccctgtctagaggaggccccagatacagtttctccgtgtgttgtaggcttttctttggccagagaagccatttaccctctagactactgtctttgctagagacagagacaatctctgtggccagagataatggggaagtgaacccagaaattctatgacagaaaacaggctgatcgtttccagttctgactgtgacgtcatcacttgacagactcgtggttaaagcaatgctctcgaggcatcaagaacacaggatgccactaaagggcatgagtggatggacacataccagttccaccacactgtgtgccagggacattaatcttttggctctcactgtttattacctctaaggctgaggagggaggatcgcttgaacctgggagatggaggttgcagtgagccgagatcgtgccactgcactccaacctgggcaacagagcaagaccccatctcaaaaaaaagttgtagaattcaacacctacttttaacagatcaaccagacaaaagatcaataaggaaagagatcacaccgctgtactccatgctggtgacagagtgagactctatctcaagaaaaaaaagtctgaaatgctaaattttatgttgtatgtattgtgtactttataaaacattgttggaagaaattaaagaagagctaaataggaagacatcccacgatcacaggttggaagtcttaatatcgttaagatgcaatactccaaagcaacctacagattcagtgtgaatatctatcaaaatcccaatggcattttttagcagctatagaaaagcccatcctaaaattcatatgcaatcaccaagggcctcaaatagccaaatcagtcttgaaaaagaacaaagtttgaggacttgcacttcttgatttcagaacttaactacaaagctataccaatcaaaaacagtgtagttctggcataaggagaggcatataagccaatgaagtagaatcaagagttcagaaataaatactatagtcaattgattttcaacaaaggtgccaagatctcagcaggaaaaagaacggtgattttggggggttctttttcattttttgttttgttttgagacagagtctcactctgttgcccaggctgtagtgcagtggcgcgatcttgactcactggcactatctcggctcactgcaacctctgcctcccgggttcaagcaattcttgtacctcagccttccgagtagctgggactacaggcatgcaccaccacgcctggctaatttttgtatttttagtaaagacggggttttgccatgttggccaggctggtctcgaaatcctgacctcaagtgatccaccccgctcagcctcccaaagtgcaggaattacaggtgtgagccactgcatccagccaagaatggtgtttttaacaaatggtactaggacaactaaaaatccatacacaaagaatgaagggctaaaactataaaacttttagaataaaacacagggataaatcttcatgaccttcgggttggcaaaggattcttagatatgacaccaaaagcacaagcaacaaaataaataatagataactggatttcatcaaattaaaacttttgggcaccaaaggacactatcaagatagtgtaaagacaatctaaaagtagaagaaaatattttcaaattatatatctgataaaggtcttattcaggatatataaatgtacaattctacaacaaacagataaaaaaccaatttattttttgagacaagttttggctctgtcacccaggctggagtgcagtggcatgatctaagttcactgcagtctcgacctcctgggttcaagcaatcctcttacctcagcgtcctgaggagctgggactacaggcatgtgccaccatgcccagctaattttttgtattttttgtagtaatggggtttcaccatgttgcccaggctggtcttgaactcatgagctcaagcaatctgcccacttcagcttcccaaagtgctgggattacaggtgtaagccactgcacctggccaaaaaaaaaatacatatatatatatatgtttgttttttttttgagacagagtctcgctctgttgcccaggctggagtgcattggcgtgatcttggctcactgcaacctctgcctcctgggttcaagcgattctgctgcctcagccccctgagtagctaggattacaggcatgcactaccacgcccagccaatttttgtatttttagtagagacggggtttcaccatgttggtcaggctggtctcgaactcctgaccttgtgatctgcctgcctcggcctcccaaagtgctgggattacaggagtgagccaccgcgcctggcccaaaaacatgttttaaatgggatttgaataggcattcccacaaagaaagatatacaaaaagatatacaggcttggcatggtggctcatgcctgtaatcccagcattttgagaggctatgggtgaatcacttgatgcccagaattcgagaccaacctggccaacgtggaaaagcccggtctctactaaaaatacaaaaattagccaagcatggtggtgcacgcctgtaattcaagctactcaatggctgagacacaagaatcgcttgaacccaggaggcagaggttgtagtgagctgagattatgccaagacacgacaacagagtgagactcagtctcaaaaaaaaaaaaaaaaaaaaaagaacaaaaagatatacaggcattcatacaaaaaatatatctaaatggaaagatgctcaacatcattagtcattatagatagtacaaacaaaaaccacaatgagttacaacttcatacccatttgaatggttatgctacaaaacaaacaaaaccagaaataacaagtgttggcaccacttgcagtgttgcacacctgtagtcccaactactcaggaggctgaggtgggaggattacttgagcccaggagtctgagaccagcctgggcaacatagtgagaccctgccttgtaaaacaaacaaacaaacaaaaacaagtattggcaagaatatggaaaaattggagccttcgtacatacactgctggtggaaaggtaaaatgatgcagctgctgtggaaaacagtctggcggttcctcaaaaagttaaacataaaattaccagatgacccagcaattctgctcctgggtatattccaaaaaaaattacaaacagatacccaaataagtacatggacatacatgttcagatgcactattcacaatcaccaaattgtggaatctcaaatgtccatcaatggatgaataaacaaatcttagtatttaatgcctgtaatcctagtactttgagaggccaacacgggcagatcacttgaggtcaggagtttgaaaccagcctagacaacatggttgaaacctcatctctaccaaaaaaaaaaaaaaaaaattagccaggtgtggtggcaccaacctgtagttccagctacttgggaggctgaaatgggagaatcacttgaacctgggaggcggaggttgcagtgagccaagatagcaccactgcactccagcctgagcaacagagtgagaccctgtctcaaaaaaacaaaacaaaacaaaacaaaaaacagtatttacatagaataaaaaggaatagattactgtatgagttacaacgtgcacaagcttctaaaacattatgctaagtgaaattaacctgacacagaaggtcacatattgtgtgattccatttatataaaatatccagaatagccaaatccataaaaacagaaagcatatatgtagttatcaggggatgagtagatagatatgtagctgatgtgtagttatccagggcagtggtccccagtctttttggcaccagaggctggttttatggaagacgacttttccacagattggggcaaggggttggggatggtttggggatgaaactgctccacctcaggtatcaggcattagattctcataaggagtgtgcaacctggatccctcgcatgcacagttcacaatagggttcttgctcctatgagaatctaatgctgccactgatctgacaggaggtggagctcaggcagtaatgatggcttgcctgccgctcacctcctgctgtgcggcccgtggtcctgggggttggggacccctgatccaggggatagagtgggttatagggagaaacttcttttcttttttttttttgagatagagttttgctctgttgcccaggctggagtgcagtggtacagtctaggctcactgcaacctctgcctcctgggttcaagcaattctcctgcctcagcctcccaagtaactgggatgacaggagcatgctaccacaactggctaattttttatatttttagtagagacagggtttcaccatagtggccaggctggtctcaaactcctgacctcgtgatctgcccacctcaggctcccaaagtgctgggattacaggtgtgagtcaccgcacctagccagggagaaacttcttaataggcacaggattttctcttggagtgacagaaatgttttggaactagatagaggtggtgagtgcacaacattgtgaatgcactaaatgccactaaattactcactttttattttattatttagtttttgagacagggtctcactgtcacccaggttggagtgcagtgatgcaatcacagctcgctgcagcctccacctcccaggctcaagcgatcctccctcctcagcctcccgagtagctgggaccacaggcatgtgccaccacgcccagctaagttttgtatttttagtagagacagggttttgtcatattgtccggcctggtctcaaattcctgggctcaagtgatcctcccgcctcagcttcccaaagtgctgggattataggtgtcagccacagcgcctgactaaattattcactttaaaatgttaattttatgttttgtgaatttcttcttagtaaatttcagttccacatgtaaaaagcttgggagttgaaactccatcctacaacaagtaaaaagctcaacaaactgaaaaatcaactctactttgttagagccatatgagaagtgaggtcacagggcaaaccactgctcccataatcagagacagaaatgcaaacattgagaacaatgtacagaagtctttataggaaccggtgccagagttaggaaacctgaactgtaatcaacaaattgttagaggctaggtgagaacaagtctgagagttaaaaacttcagggggactccctcatatgaggaccccatacttttgtgaattttaccttctcaagaagaatccccttgagcttccagcagggagacggaaataggaatcattctgaaagcttcagagcactgtgctcctcttgacaaactctgccctcaggagaagctagttaaccagagcctaacattctggggttttatcagagcctaactgaactaggagaagggtaaaacctaattctagtcagctctaactttccacgtgggagaagagaaatactcaactaaagctcaccctagccaaccatgtgggagaaggatagtacccaatcccagcctactctcgccatcctttcctacctaagggtagagaagaaaatctgagaaaagctcggtgacattcacagtccagtggcacagggtcatcagaaaagacctaattgtaggacctccccctacacctcaccaccacatcactaaaggcctatttacgtagcagttccttttacccagtacattacttccagctatcaagaaaaaaattacagggcatgttaaaaagcaaagaacagttcaaagagacagagcaagcattagaaccagacctggcacaagggatgctgaaattatcagatagggaattttttttttttttttttttgagacagagtctcactctgtcacccaggttggagtgcagtggcgtgatctcggctcactgcaacctctgcctcctgggttcaaatgattcttgtgcctcagcctcccgaatagctgggattgcaggcgtgtaccactatgcccagttaatttttgtatttttagtagagatggggtttcaccaagttgcccaggctgatcttgaactcctggcctcatgtgatctgcccacctctgccacccaaagtgctgggattacaggtgtgagtcactgtgtctggccagacatggaatttttttttttttttttttagacagggtcttgctctgtcacccaggctgaagtgcagtggcatgatctcggctcaccgcagcatccgcctcccaggttcaagtgattctcctgccttagcttcctgagtagccgggattataagtgtgcgacaccatgccgggctaatttttgtatttttagtagagacaggtttcaccatgttggccaagctggtctcgaatgcctgacctcaggtgatcttctgcccgactcagcatcccaaagtgttgggattacaggcctgagccaccatgcccggccaaggaatttaaaacaactaactatgattaaaatgccaagggttctcgttaagcagacagcatgcaagaacagacgggcaatgaaagcagaaaggtggaaatcttaagaacaataaaaaaaatgctacagataaaaacactgtaacagaaatgaagaatgcctttgatagacgtatgagtagtctgaacatgactaagcagagaatctctgagatttagaatatcttcttttttttcttttgagatggagtctcactctgtcacccaggctggagtgcagcggcacgatctcggctcgctgcaatctccgcctcccaggctcaagcaattctcgcacctcagcttcccaagtagctgggattacagacgcgcgctatcacgcccagctgatttttgtatttttagtagagacagggtttctccatgttggtcaggctggtctcgaactcccgacctcaggtgatccgcccacctcagcctcccaaagtgctggaattacaggtgtgagccacagcgcctggccttgctttaggatatcttaatagaaacctccaaaactgagaagcaaagagaacaaagacaaaaaaaaaaaaaaaaaaaaaaacaccagaatatgtggagcaattacaaaaggtgtaacatacatgtaaatgggaatagcagaaggaaaagagagacaggaagagaagaaatattggactgcaagtttcctcaaatcagtgtcagacaccaaaccacagatccaagaaggtcaaagaacactgagcaggataaatgacaaatgaaacgaaacaaaaactctgcacataagtgtgacattttcaaactacaggaaatcaaagataaaggaaaaatcctgaaagaagtcagaggaaaagaaagaaatctgaaagaagtcagaggaaaaaatcatgttacctatagagacgcaaagataaaaattacatgtgtctcctcagaaatcatgcaagaaggaagagtggagtgaaatatttgagtgttgagagaaaaacactaccaacctagaattctgtacgctgtgaaaatatccttcaaatttgaaggagaaatactttctcggacaaacaaaaattgagagaatttattgccagtagacctgtcttgtaataaataaattcttttttttctttttcttttttttgagacagggtcacactactctgttgcccaggctagagtgcagtggcacgatcttggctcactgcagcttccgcctcctgggctcaaggatccttccacctcagcctcctgaatagctgagactacaggcacttgccacggcgcctggctaattttttttgtattttttgtggagacagggtttctccgtgttgcccaggttggtctcaaactcctgtgctcaagcaatccacccgtcttggcctcccaaagtgctgggattataggtgtaaaccaccgtgcctggccatcaatttttttaaggaaaggaggaaaacaatacagatcagaaatttggatctacataaagaaagaaagaacatgaaagaaggaataagttcacatgacttgagcttgtagctatgtcttctgcacagattgggtaatggaacactaaatttttttttgaggggggacggagtctggctctgtccccccaggctggagtgcagtggcgcaatctcggctgactgcaagctccgtttcctgggttcacgccattctcctgcctcagcctcccgagtagctgggacaacaggcacctgccaccacccccagctaatttttttgtatttttagtagagacagggtttcaccatgttagccaggatggtctcgatctcctgaccttgtgatctgcccacctcggccgatggaacactaaatttttatacttgaaaatgacagcctaggagaatcgcgtgaacctgggaggcagaggttgcagtgagctgagactgcaccattgcactctagcctggggaacaagaacgaaacttcgtccccaaaaaaaaacaaaatcaaaatcaaaaacaaaacaaaacaacaacaaaataaaacacaatagagagcctagaaatatacccacataaatatagtcaattgatcttctacaaaagagaaaaggtagtacaatggagaaaagtgtttctaacaaatggtgctggaacaactggacatccacatacaaaaaaaaaagatgaaccatagaccttacacttttcacaaaagttaactcaaaatggacctaaatgtaaaacacaaattgtaaaacttttggaagacaacataggagaaaatctagatgaatttggatttggtgatgcttttcagatacaacatcaaagccacaactgataaaggaaagaattgataagctggacctcataaatttaaacatttccgatccgcagccgggcatggtggctgatgcctgtaatcccagcactttgggaggctgaggtgggtggatcacctgagctcaggagtttgagatcagcctgggcaacaaggaaaaacactgtctctaccaaagatatgaaaaaaaaaaattagctgggcatggtggtgcatgcctgtggtcccagctacctaggggtgctgatgtgggaggatggcttcagctagggaggaagaggttacagtgagccgagattgagccactgcacttcaaccctggtgacagagtgagaccccatctcaaaaaaaaaaaaaaaaaaattctgctctgcaaaagacagtgtcaagagaatgaaaagacacagactgggagaaaatagttcccaaagacatatctgataaagaagtgttgttcaaaatatagaaagaactggccacgtgctgcggctcatgcctgtaatcccagcactttgggaggccgaggcaggcagatcacgaggtcaggagatcgagaccatcctggctaacacggtgaaaccccatctctactgaaaatataaaaaattagctgggcgtggtggcaggcgcctgtagtcccagctacttgggaggctgaggtagaaggattgcttgagcccaggaggtgcaggttgcagtgagctgagatcacatcactgcactccagcctgggcaacagagcaggaccctgtcaaaaaaccaaaacaacaataacaaagcaaaagaaaaaaaattaaataagaaaacaattttaaaatgtgtgaaagatctgatcagacatatcatcgaataaaatataaagatggcagataagcatgtgagatgctcaacattatatgtcatcatggaattgcaaattcaaacaacagagagacaccaccgcaagcccattagagtggccaaaatccagaacactgacaacgccaaatgctggggaggatgtggagcaacaggaactctcattcattgctggtgggaatgcaaaatggtatagctactttgttgttgttgttgttgttgttgttgttttgagacagagtctcactctgtagcccaggctgaagtgcagtggcacgatcttgctcattgctacctctgcctcccgggtcctggttcaagcaattctgcctcagcgtcctgagtagctgggattacaggcatgtgccaccatgcccagctaatttttgtatttttagtagagaagaggtttcaccatcttggccaggctggtctccaactcccgacctcaggtgatccacctgccttggcctcccaaagtgctgggattacaggagtgagccaccgcaccggcctgttgttttttgtttgtttgtttgttttttgagacggagtcttgctctgtcgcccaggctggaatgcagtggcgcaatctcagctcactgcaacctccaccttctggattcaaatgattcttgtgcctcagtctcctgagtaactacgactacaggctcgtgccccaggcccagctaatttttgtatttttagtagagacagggtttctccatgttgatcaggccggtcttaaactcctgacctcaggtgatcctcccacttcagcctcccaaagtgctgggattacaggcgtgagccaccgcgcctggccggtatagctactttggaagacagtttggaagtttcttacaaatctaaatgtgctttgatgcaagtatatttgaatccctttccatctgataactgagcaaaataataattttttaaaaagcataaaaactaagcttacacttaccatatgattcagcagttactcttgagtatttattcaaaggagttgaaaacttacgtccacacaaaaacctgtgcatggatgtttactcattatgaattcagctttattcataattaccaaaactttggtagatgtccttaagtaggtgaatgaataaataaatcatagtatctagataatggaatattattcagtgctaaaaagaaatgagctaccaagccatgaacacatggaggaaacagaaatacagatgactaagtcaaagaagccttttgaaaaggctacaaagtgtttgattacagctatatgacattttggaaaaggcaaaaccgtgggaacagaaaatgatcagtggttgccaagggttagggaggagagagggaaggatagggagaatgcaggcgacttttagggcagtgaaactactctgtatgacattatagtggtggatgcatgtcagtatatgtttatccaaacacatagaatacaacaccaagcgtgaaccctaatgtaatgtatgtgctttgggagatgtatcaatgcaggctcatcagttgtaacaagcataacaacttttggttggggattttgataatggcagtggctatgcatgtgtgggtcaggatatttctctaccaaggaaggtagacataccttcaacagccaacaattacatgaaaagatgttcaacattactagtccttagggaaatgcaaatcaaaaccacaatgaaatgctacttcacgcctactaggacggctatcataataatgtcaaaatgcagcctgggcaacacagtgaaactccatctctaccagaaatacaaaaattagctgcgtgtgtgacatgcacgtgtggtcccagctacttggtgggctgaggcaagaggatcccttgagcccaggaggcagaagttgcagtgagtccagatcgtgccactgcactccagcctgggctgtaaagtaaaactctgactgaaaaaaaaaatgtaaaaatggacaataacaagtgttcatgagaatgtggagaaactgggggtctagtgcgttgctggtgggaatgtaaaatggtgcagctcttctggaagacagtttggccaatcctcaaagtttaacatagaataccacccagcaattccactcataaatatatgcccaaaggaattgaaagtagggcttctttcaaagtactattagaagtaaaaaaagaaaaaaattggctgggtgaggtggctcacatccgtaattccagcactgtgggaggctggggtggtggagcacttggggataggagtttgagaccagcctggccaacctgacaaaaccctgtctctactcaaaatacagaatttagcctgtaatcccagccacttgggagtctgaggcatgagaatcacctgagcccgggaggtggaggttggttgctgtgagcctagactgcgctcctgcactccagcctaggtgacagagtgagattctgtctcaaaaacaaaacaaaacaaaaacaaatgtttttaattttaaaaaattttaaaaaggaagcagggtctcaaagagatactttcacctcaatgttcatagcaactttattcacaatagacaaaaggtagaaaaaactcagatgtccatccaaccgacgaatggataaacgaactatggcatacacatacagttgacaattattcagtgagaagacagagcgaagcgccgacatgcactacaacatggatgaaccgtgaaaacatcctcagcgaaagcactcagacacaaaagaccatgtatcgtgtgatgccacttacataatacacctgttttggaaaaatttcccaaccgggttttacctttgctctcacactgcaacaaacgcagaagatttctgtgaccaaatgtggggacatctccccatcaatagacaagcaatcagttctgcagtagacaccagcaaggtgccctccaattcaattccaacactatctacccagggtgagggctcagttcccaaggctgactcttcctttcccaccagtccagacctctggaacttctgacccacaagcttcaagttgggttcccacgatcgaccccctttggattcaattaatttgctagagcggctcacagaactcagggaaacacttacttaggaggcttactggtttattgtgaagggcattttaaaggatacaaagaaacagccagatgaagagagacacagggtgacatctggaagggtcctgagcacaggagcttctgttcctgcagttggggagtgccaccctcccaggacagggatgagttctttttcaccttcctgccaccctcccaggacagggatgagttctttttcaccttcctgccaccctcccaggacagggatgagttctttttcaccttcctgcctgcctccacgtgttcagccatctggcagctctctggacctagtcctcctgggttttatgaaagcttcttgagatcagcattccttcccccagggtgtggggcaggaccctctctggaatgaggatgatgtgacccacaattagaaagacaggggaagattagaggccgccttggggcaggtgagaggaggcaggagaaggtcagagagattctgtttcctgaggcctgacatgccagatgtgataacaacagaatgcagcaagggctgtggagttgagtcaggaacccagggtggaaacctgtgtgtatacataacaccacgacaccagagaaggcaactcctacatacctatgataccacaacaccagagaaggcaaatccacaaagagggaaagtagattggtggctgccagaggcttggggagggggaatgaagatgatgcttaatttgtacaaggtttcattggagaggatgaaaaatgctggaataggctgggcgcagtggctcatgcctgtaatcccagcactctgggaggctgaggttggtggatcacctgaggtcaggagttcaagaccagcctgaccaacacggtgaaaccccgtctctattaaaaatacaaaaattagccaggcgtggtggtgcgtgcctgttattccagctactcgggaggctgaggcaggagaattgcttgaacccaggaggcaaatgttgcagtgagtcgagattgcgccactgcactccagtctgggtgacaaagcaaaactctgtctcagaaaaaaaaaaaagaaaagaaaaatgttggaataggtaatggcgatgggtgcatagtgttgtgaaggtggtggaaaccacagactggtgtactttaaggggttaaaatgatggattttatgttaaatgcattctccctcaataatgataaaaaaagaataggtttctgggattgaagggcctcaggggcctcagcatctgaagattcctcagttgcctgggctccttggacctcttgcagtgatgtggcaagggtagaccctgtgccggtcactggaggagcggggtgacgggtgggtgggggcagatactactgtgtcgtgtggcagcacagccactagcccagcagggccagggatgcacagaagagggaggagccaaggaaggcttcagagaggcagtgatgtctcagtaccgtcttgaaggatgagtagcagttcaccaagcagactgagaggtagggggacttgaggacacccagggaggaactgagggcagcagaagatggagctgggtcgggggagggccaggttccagggcccctggtgccgagcccaaggccttgcacttgatctctggagcagtaaaggctgttgaaggtaagtttgaaacaggagtgtcatgtccagggttaggcttttagggtgttctgacatactgtgcgtggtgagtagattcaaaaggataagactggaggccagggatcagtccctccccacctgtgctggacgcctggtctgcatcggttccattacctcccagcagcccttcccggctgccttcacttcccttccactctgctgctctgccggctgagctcagggtcctcccatccaggtgcccactcaaccactcccttcgagggcctgaggcttaacagtccaacctccatcactccctgcacaaacccaacctcacccaaagctcagtgggcttggctgggaccccaggggaggaggggggtcattccttcccactgaatacctgtcacgagccatgctgggtggtggagtttaatgttaaaagggcagattcgagagctggacaatttgggttcaaagtcctcctctgtctcttagttgctgtgtgactttgagcaagttcctctgtttctctgtgcctcggattttccatccctcaaggagttgggagagttgagggtggacgatgcgtgggcacatggtgactgctcggtaggtgtctgtaaccatggtaaagatgaagctgtgggctggcccctggggtcccagccgagcccactgagctttggggagggtgggtttgggtggggagtgatggagggtggactctcaaacctgaagccctcaaggggagtggtcaagagggtacctggatgagagaatgcagcgctcggccagcagagcagcggagtggagggaagtgaaggccgcctggaagggctgcggggaggtgaccaaccaatgcagatgcaggtacccagcacaggtgggcaggtgagcattcaggaaatggttgtctgggacccaccacccttcacaaagcacctggcaacactctccttgagcctctgtatcagtggaaggaaactgcttgacctggctggtgaggggagcccaggcagggtcgggggcacccctaggggccagcttgctggtctaaaccaaggccaaggccagaggtcttacaaaaaagcccagcccacaccaaagcataaaaagtgataacttgggccggacacagtggcttacgcctgtaatcccagcactttggaaggctgcttgagcccaggagtttgacaacagcctgggcaacatggtgagaccctgtcgctataaaaaaatacccacaaaactttgctggctatggtggtgcatgcctgtagtcccagctactcaggaggctgaggtaggaggatcccttgagcccaggaggctgagactgcagtgagctgtgattgtaccactgcactccagcctgggcaatagagccagacattgtctcaaaaaaataaaataaaataaagtgataattctcctttctcctctccttagcagtttggtgtgtgtccttcaaaacactgtggctgttcagccccttacattatatataatgagaggataaacatggatatgggtctatattctctagcttgcttttttcacttacaagtgtatcatccttccatgccattatataaagccacctcatctttttaatggtcatggtgttccatggtttggaggtctcataattcactcaccaccttctctgggtggttatgtaggaaatttctaaactttttggctgccctgagcacgcttgcccttgtagcttaggactcttggggagtttctccatcaggacagacaagcagacaatacttagcaggaataaatgatcagtcttgtgcttattgcaaaagcaggagcaacagataagctggaactagacttggcaggcaggcagagagaggccctggagggattcgctgcaagctgccgcagatgaccgtgggctcccttcatgggctcccttcactcatgtgcagtccgttccagtgctgcccagctcatcacatggttggtcatgccttggtcacaattctgaagcacttaagaaagaaactcataagctcatagatgccccacacacaagatacaaatggctccagtcgtcctgcttaggctctgctgacccctccacatcccgttcctggttctcatgagtctgagggacttcttccggggatggaagaggcttcaaggggtgtggtacggatgacttctcagctaggacggtcttcatgtttcttggggtgagtgaataggtgatcccgttgggtcaggtggggtgggaatgtgggtgtgactgggcttcgggtggcgtttcttctcccgcagacatggctgggcttgtttggtacttctccctccatgtcctccgctgccaccctcctcctgtccccgtccttcaggacagaaccagcaaatcagtctcagccccttaagagcacctttactggtgctttctttccctaggattttttttctcttttttcatttttttccatttaaactcagtggcaaaaatcccaaggacttttgatccaaaggcggcagttatcactaagtggtttatttccttctaagacctagccaacggtctcagagccaatgctgctggtacaactactctattaatgggatagttttggtaagtctggatcctcccagctgggtcctcctgatcagtgcaaagcagccttttgttttaaaacacattgcaagcaatggcttgggaagtaaacaccatctgaggctcgctggccagaggcaaggggagacggcaggcagttgagcctgcctgagggttctctcagcagtgacttcctttttcccttccttcttctgcctagtcctgtatgtgaggactattaattgttttttgttgttgttgttgtttgttttgtgagatggagtctccctctgttgcccaggctggactgcaatggcgcagtcttggctcactgcaatctctacctcctgagttcaagcaattctcctgcctcagcctcccaagtagctgggattacaggtgcgtaccaccatgtctggctaatttttgtatttttagtagagacgaggttttgccatgttggccaggctggtctcaaactcctgatctcaggtgatccacccgccttggcctcccaaaggcatgagcctcccaagggcatgagccactgctcctggccgaggggattaatttttacccgcacctcagggttattgagtaacaggctggctgggtttgcaggccagcgtgttcctggtggcagccgctcactcattaacacttctggaagtgctgcatgtctggttaaactgcaaatgctttgcaaagtcacgagtcatgtcactgagcagaggcgtgagactgccggccagccctgctgtgtacactgatagaattagtgagcgagcgtcccactctgatggaatccagatggaactcgtcactgtcactgcggtggagacggtggggccacatctgcactgaatcctactctgcgccttcaatggctgcgtaatggcggatggccatttccttgactaggatgagacattgcctactctgcgtggctgctgtgagcgtgaaatgggatcatgtgcggaacagccacgcatggtccgtgaaatgggatcatgtgcagaacagccacgcatggtccttggtgtgtgacagatattgggtccctctgtggtcccaggcagacattgcccggggtgggggccgaatgcatggtcaagttgaggggcctgggactgtttcacgggtctagaaaaagaaagcagaaacgctggaagcaggactttattgtccgacatggggctgcctctgagcctgggctgtgttggctggacgtgagccataatgcaggtgtccccctcccaagccctgctcagtccactcacagcccgatggccaagggaggacatggctgcccgccacggcagtatcttcagaggtgaggcggttgtccctacgctctatgcttcttatacaaattagatataggtgaagccacccattaagcaacccagcctttctgggactatttgggctgcctccgggtccactaaatgcggttcattttccccaagccccctccgagttcaaggaggctccttcctttcctcctcccacttgcttctcccaggctccctgactcctgcgctctgggatctgcaccccaccatggggtgaggaagctgaactgcatggtgaggcagctgccctgcatgcagccacatcatgggctggagatgccactgtccgcttggtttaatgatcaatgagctccctgccaggaaaccctttctgacctggtttgcccctcagtccctcgggctcatacctagtgcctgcggcaggacagccatggccgccaactccaccagcgacctccacactcccgggacgcagctgagcgtggctgacatcatcgtcatcactgtgtattttgctctgaatgtggccgtgggcatatgggtaaggggacctgtggtggtgttggccaagtgggctctcagggttggtgcttggggtgggaaccggggtccagcatgtccctgtggtgtcagcattggtcccagctggtggcctagtgatccttgtggtcctcctcccagcctggggtagacttgcttggagaccttgaccaagcccgtttctctctttgggtaatggcgtctccatctgcaaagtgaggaggaggaaattctctctaacaggtaactgggcttttgtgctgctgcccagctggagtccttgggtgtggcccatcagcctcctggtcccagtctccatggtgtcagtgactcctgtctgcttgaacaacaggctccccgggattccctggctgcaccccagagctgctggatcagaatccggaggcagggagggccctgggaactgggggtctttattttgaacaagctccctggggatttatgtcctgtggcctagccctagatcataagccggttctttctcccttcataacagtgagaaatgagcagagatctgaccccacacacagattccaggggcagcggggcccctggggacaggctgtttcatgtgcagatggagaaaccgaggctctggccctgcagcaagggaagggctcctctggtctatcgtggaggccttcctgagggaaggtggacacagcctggttcaggtcacctgctccacgcttagcgcctggggatgttgggctccacttcttaagccccagaggtccccagcctggcatccctgagccctgacagtctcctggggagaatgagtaccccttctttttttttttttttttttttaactgagacggagtctagcactgtcacctgggctggagtgcagtggcactatctcggctcactgcaacctccacctcctgggttcaaacaattctgcctcagcctcctgagtagctgggattacaggcgtccactaccacacccaggtaatgttttgtatttttagtagagacagagttttaccgtgttggccaggctagtctcgaactcctgacctcatgatttgcccgcctcggcctcccaaagtgctagaattacaggcgtgagccaccgcgcccggccgagtacccgttcttatcttccataacccctggcctaagcacgaaggcctggcaaacaggagactggtcacgtcccctcagcttcctgggcctcagtgttctgatctgttatatggagacaccacctacctggggtgaggtctgctatcaaggggcccacacaggaccagaccttgctgctgccattggttctacagtggtagcagtggtggtggtggtggcagttgtagcagtggtgattataagagtagcagccgcagtcattaaaattaattatcacaggttggatttcaaaaatctgaaacccaaaatctggaacattttgaacaccaacatgatgctcaaagcaaatgctcattggagcatctcagattttagagttttgggttggggatgttcaactggcaggtattctgtaagtatctccaaatctgaaagagtccgaaatccaaaacttttctggtttcaaatatttcggataacggctcctcaacctgtatgtgattaaatattaactcacaagtagcccagtgctggccatcggcaaagccgagttcaagtctcggctctgctctgtgtacttaagtcacttaatctctgtgggcttcagtttcctcaaacacgcaatgcgggtttctgtgcagcccacatctcagggctgttccaaggagcaagggtccaatggaagtgaaaatctgttgcaaactgtaacgtgctatattcctgtgacagttggtggctagaattcagaggaggaggtgcccacgtggggcagaacagacagtggagggtttctggatgaggggaggtaagggccaggcaagatctgaagagggaaagaggaggggagacaaggctgtcctggctagcacgtctaagaaagatgttctgggcacctgaggccagaccctttgtagcccagtgacttgggccaccagcccttgttgcccatgacccacctctcctagtgagtcagcttgctgtttgcaggctggtgcccctggaagtagggctgtaggagttctgccctgtccctcctagcaggctaggctggcccagctgggagcggctggcaagagagcagtgagcacatccagaaaagatcagaaccagacagggaggatgctggagatgcatcccacagggagaagcagacagagcaagccaggcaggtgcagccctgcaaagatgtttagatggtgggcctgggagagtctggcgggggccggggggaggcctttaaggaagagatgttcctggaggaggggactttgagctgagcctttgcattcattaaagtatctgttaacaagtgactgaaaactgctttcaaatgagctctaagaatataggaaatgtaggccgggcgcagtggctcatgcctgtaatcccagcactttgggaggcctaggcgggtggatcacgaggtcaggagtttgagaccagcctggccagcatggtgaaagcccgtctctacttttgtattattttgtgataatacaaaaattagccaggcgtggtgccaggcgcctgtaatcccagctactcaggaggctgaggcaggagaattgcttgaaaccggaaggcggaggtcgcaatgagctgagatcacgccactgcactccagcatgggcaaaagagtgaaacactgtatcaaaaaaaaaaaaaaaaaaaaaaaaagaattcaggaaatgtaattgtgtccagcaatagaaagggcttcaggtgcagtatgatccagggattcacagcattattaaggatacagctacacctcactttggttctctcagcctccatccatgtgtagctctgtcctaagcccagctcccctcgtgtcctgatgtgaaatgaccagccctgcgattgagcctgagttgaaatccaggctgcaccacttgctagatgggtgtgttttcatctctgagaccatcagtttcctcattggtaacatggcacctgcttcatagagctgttgcgaggactaagaactccacacagatcaagaagttgaagccaactctggcatgggggccttcggggaaccttaaatgggtacatgtggcccccagcaactgccagcagcccccagagccccagatataagaaggcaactggcaatgcccactataggcttgaaagatgagaagggttaggaaaaagcatgggctgtaaacatagatgctttggagttgtgcagtgcacagcgtacacatctggatatggccatcctggccaagactgtgagccttcagactatgctgcctttagtacagcaagatcacggcacacaaagagaaagtggtgggagttggagctggagagaggcaggagccacatcaaaagttctgaactgggtgtggtggtgtccacgtggttcctgctactcaggaagctgagatggggagatcacgtgagcccaggagttcaagacctgcctgggcaacataatgagaccctgtcttaaaaataaaaataaataggccgggcgcggtggctcatgcctgtaatcccagcactttgggaggccgaggtgggcagatcacctgaggtcgggagtccaagaccagcctgaccaacatggaggaaccccatctctactaaaaatacaaaattagccgggcatggtggcacatgcctgtaatcccagctactagggaggctgaggcaggagaatcgcttgaacccgggaggcagaggttgcggtgagccaagatcgtgccattgcactccatcctgggcaacaagagcgaaactctgtctcaaaaataaataaataaataaataaataaataaataaataaataaataacaaatagataaagctttgaatggtgagtacatacaatgaagcctaatcatcctgagtatagggcagggcaattaaagtcaggaagaaagagacctgcatattgatggatatattttgtgatccagccttatgtatgttctgaaaagaaatacaaaatttgtatctaaatacctgtcctgtgtccctcttttcaaattcttctgttttttcttttttctttctgttttttttttttttttttttttctgttttgagacagagtcttgctctgcagcccaggctggagggcagtggcgccatcttggctcactgcagccttgacttcctggtctcaagtgatcctcccacctcagactctagagtagctgggattacaagcatgcaccaccacgcccagctaattttaaaactttttatagagacagagttccactatgttgcccaggctggtcttgaatccctggcttgagtaaccctccttccttggcctcccaaagtgttgggattacaggcatgagccaccacgcctggatgatttaacttaaatttctcccatccaaatagcactaaagacaggcttgaaaaatccatgtactcactgacccttatctcagcatgctacgtgtactaacccactaaagctcataaaaaccctgtgagggttaggaagccaaggcaggcagatcacatgaggtcaggaatttgagaccagcctggccaacatagtgaaaccccctcctactaaaaacacaaaaaattagccaggtgtggtggtgcgcacctgtaatcccagctactcgggaggctgaggcaggagaaccgctcgaacccgggaggtgaaggttgccgtgagccaagatctgtcactgcattccagccagggtgacggagtgagattctgtctcaaaaaacaaaacaaaacaaaattcatgaaggaagaacttcttaggaccacattacagaggaagaaaccaaggcatacgcgttcagtaacttgccccaggtaacacggccaggaagcagggaagacaggattttactctcagacgttccgactccagaatttttattccacttacatggaggacaaaattctatactccccgtaaaccaaaggcatgtgggaatacgtaggtaaggagctgactgcttctgttctttttataaaagttgagataaaatttacataatatacaattcatcattttaaccattttattttattttattttatttatttattttgagacggagccttgctctgtcaccaggctggagtgcagtggcacgatctcggctcactgcaacctccacctcccgggttcaagcaattctgcctcagcctcccgagtagctgggactacaggcgcctgccaccacgcccagctaatttttgtatttttagtagagacagggtttcaccatgttggccaggatggactcgttctcttgacctcgtgatccacccacctcggcctcccaaagtgctgggattacaggcgtgagccaccgcgccagcccattttaaccattttaaagtgtgcaattcatggcatttagtacatttgcaatgctgcgcaaccattacctgtagctagctccaaaacattttcatcctgtccccatcaaagtcaagcaccgttcttcctgcctcccagcccctggcaacaactcatctgctttctgtctctataaatttgcctgttctggacttttcatataaatggaatcatacaattcgtggccttttgtgtctgtctgtgttcatgaagcatcatgttgtcaaggtccatccaagttgggcatgcatcagagcttcattcccaagatatttgttgtttttttccagacaggatttcactctgttgcccaggctgcagtgcagtggcacaatcaccgctcactgcagcatccacctcctgggctcaagagatgctcccacctcagtgtcctaagtagcgggggccacaggtgtgtgccaccaaaccctgcattttttgtagacctggggtctcactatgttgccagtctggtctcaaactgctaggctcaagtgatccgcttacctccgcctcccaatgtgctgggattacaggcatgagctactgcacccaatagaacttcattccttttgaagactgaataatatttctttatataggatataccacattttgtttatttactcatcagtcgacagaaatgtgggttgttttcacttttggctattatgaataatgctgctatgaacattcgtgtacaagtttctgagtggatgtgtgttttcaattcttttggacatatacctaggagtggaacttctgggtcatatggtgattctatgcgtaaccttttgaggagctgccaagccgtttcccattcgacttcccagcagcagtgtgcgggcttccaactcctgtcccttttctcctcttgcagtcctcttgtcgggccagtaggaacacggtgaatggctacttcctggcaggccgggacatgacgtggtggccggtgagtgcaccctgacttctcacacacccccactttgtccgtggggctgtgtctgatctctaggtcacctggcatctgtatctttgagccagtccaattcagtggagcaggccggaggctggcaggaggtccccaagtgaggggcatagggctgagctgctagaaattgtgtaaggggcaggggctatggagtctgaaacttacatccgctccttagctgtgcagctagtcatgggtagaacacacaccctgggctcctcatccgtgaggtggggctaggaccccgcttaggtttgtgaggatgagggagaagctattaggcccaggatggggccggcgcagggagcctgctgctgatgcgtttccctttctctcctccagattggagcctccctcttcgccagcagcgagggctctggcctcttcattggactggcgggctcaggcgcggcaggaggtctggccgtggcaggcttcgagtggaatgtgagtcctggaggactggcggcctgtgggagggccagggcacaggatgtggtcgcagcactggagggggacagctcccagtggctggtgtcagccgatgtccaggtgggctctgtgcagtgctgttcctgggccaaatcgtgtcttcagaataccaaggtgctggatggcacgactggcagggagctgtgggccttgcccagacctagagaggggaaggagccacccaggatctcatggcaagtcaggaggggctgggggaagccaggcctccggatggctcatcccagccatgtctgctttgtctctggagcagagctgtgggagctgcacctgcagtcctcacctgtctctgtccccataggccacgtacgtgctgctggcactggcatgggtgttcgtgcccatctacatctcctcagaggtgagtctactcatggggcctccagctggggggctgggccttggtccaagttggtggtagtaatgggcaggaccaccgtggcctcacatcaggagttggtaaactcttagggctgggtttgctattagcccgactaatatttctatcaacctgctaaggtggatcccgactaatatttctatcaacctgctaaggtggatcccctcagacctcagcctgggtgccgtgttggctggtttccactgccctgagtgctgcatctcaggaataatgtcccatccagctgggcacataggctgtacaactgggccatgcacctggtttgcacacctggcccacacacctgggtagcatacctgggctgtacccctgggctgcgtacctgaatggcacacctgggccgcacaattggctgcaccatcgtcgactctgcccactccttcagccccagccatgcagccactaagtccagtcaactccacttcctggatgtctctcagcctgtccccagctctgcccctcacagccacctccctcatccagcctcatcatagtgcacctggatttgtcataacagcctctaaacttgtccctctgtcccagccacggcccctccaatccattcctcgtctcagccctaaagagccagtctagggatctcagcctgccactcccctgcctgacaccctcggggcgcagccggagcagcccgggattccaggccgggtgctggggctgtaaggggtcagtgcctgggccttgcccttgagaggctcgcagctgctttgtggcggggggagaggcagagtgattgagacaggccctgcctggagccctgggcatcatctggaggatgcttagcccctacccatgtgccttcccagatcgtcaccttacctgagtacattcagaagcgctacgggggccagcggatccgcatgtacctgtctgtcctgtccctgctactgtctgtcttcaccaagatatcggtgagctgcccccggctccctgctggcatagcctggaaacatcgccaatctgtgggcccctcaagaggacctgacatcttctcattcatctctgccttgtttaacagctgggcaaattgaggcccagagaggggcaatgacttgcccagggtcacgcagcgagtctggacaggtagtccagggcccccggggtgtaggctcagcagccagccctagtcagggacagaacacaacctggtgacctctgctttgcctcaggttctagacacagggtgttaggacggttctcggtctgaggtcagttctggggccggcaccggggtgagccacgatctcccactagggggcgccaaaagcccacgtggtcttagccacatctggtctgcactgagctgacctgcctctcaccccaaggctggtgggctccatcactgacacccatccttgggggcctggccctgcccccacgggcatattaagagcaggagcacacctcgaatgtcagggtcaggagaagcatagagctcatcttgtccaagcccctgactttacagagagggaaactaaggcccagagaagggaaagagcttgtcctaaccctcccggtgacctcatggcaacactaggccttctgctctcactccaagtccctgggggcagctagcttcatccagccccaggcttctgaaggggcttgagtcctggggctgcctgattctggctgagagagctgacactagcccctgcgacctccgagcctccctgtgcctggggctcctcccttgtaaggaggggcggcagaccttgtctcctagggctcctgtgagttggtggtagcaatgggcaggaccaccgtgtgagggctgctgtgtctgcgggaagtgctctgtgaggcccagctttccctcagaggcaaatggcctcctgggccctcttcattcagtcctgggactaggaaagcccagaagaggcgtcgatttagtgaagggaatggaggtgcagaggccggagaggtagaggcctcgctggtcagccaggagctgtgggcagggctacctgggaagagggccctaaagggtccatccagagcccccacggggccccggtgggggtctcatgcagcatctgacccgccctctcctctcctggggcatcccctcggcagcctcagcctggcctctatctgcactggtgttgctaggtgactctgaggggattcccagagtgtctcatccttcgtgtgggcaggtctcaggagtggccagcagcaaaccccgtaccgcagtcttcgccagatgcccttggcgtactgtaggaggtttgctttctctgggagccctttagagtccggagggacttggccttggcctgcccttaaggctgagtttagagctttccactcatactcttccttcctctcccacatttcttgatctccaccccacccccatgccagccacccccatgccagccacctccctggaaaccagggatacagaaataaacaagacctggccctggtctgccaggggctcgcactgtggtgagaaatagatggatgcatgggacaggcatgaaactcagaagaggacacagcggggcttgctgggggtggcatttgagttgggctctgatggagacagggatactgatgggggatgggagcaaatgacaaagagagaggtgggaagaggcaggatgtgtctgggggtggtcggggctggaggcttagactctaggagtcactaagtcagacacttctggggccagataaagaacagcgtggagagaagctgggagtgagtaataggcagtggtggggacaaaggcaaaccagagaacgtgccccaggattgacacacaacaggcccgtgtgccacatttgcctctcggctgccagttttcagggtctggcctgcagtgagagatgaggcaagggaggtctgattgtaagaggttgaagtgcccaaggtgcccaggtggagcgggggtggtgtttaggagccggggtggtgtttaagtgggagagtgacatggtcgtgtttgtactttgtgctctctggaatcttccagagggtggactggaggtgagagagacaagaggaggccaggcttgtgaggaggccccaggtaggtctggtgagggagggagactgagccatgggcacagggttctctgccccctgtttcaccctgctggcttctctgcagtagagcttatacctcacactcggagagtcctgaaagtggatggcttgggcggaacttctagaaaggcagagggggccggcgtggtggctcacgcctataatcctagcaatttgggaggctgaggcaggcggattgcctgagctcaggagttcaaaaccagcctaggcaacacggtgaaactccatctctactaaaatacaaaaaaattagccaaatgtggtggcatgcgcctgtagctactcaggaggctgaggcaggagaattacttgaactggggagatggaggttacagtgagctgactctccaaaaataaaaagaacaaaaggcagagggaagagttcagtgaagtgggaggaccttagaaacaatcttgtccagctctccgagtttacagatgacacactgaggtccaggtcacagcgagtcaggcagggactactgttagaacccaggtctgtgcctcccaccacaagaggcccaacctcagccctgctgccctgaagcagccaggacgtggcctttcaaactccactttgtgatgggggtgattcagtttacccaactataaaacagggagcacccactcacatcaaggctgggcttcagaaccaacgctggggctgcctggatgaagcagagggcgaagcttgaggaatgctaattgctgggcttggctgcgagaggactggggctaccctggctgtttgaagtgcacgcgcccaggcggtccccagaggccctgacctcactgggctgtgccccgggaatgcctcacatgtctgcgcatccagcacccgtcccagccactgcccgtgtggacagagatcttagggtgcctgctgccatccctcaggcaggggcactggcccacaggaggaccggcgatggcagggcctggagaatcaccaccctgaccctcagacgaatgggcccaagcccagctccatcattgtggggctctagccagtcatttaacctctggaactgggcacgatgccccatgccacttgcagtaaaggtcctccacgggggtcgctttgcgccctcactgacctcacccctccctcgccctgttgcccccacccgctccagccacactggcctctgcgcttccatgaacacaccaggcatggtcctgcctcagggcctttgcatttgctgtggcctctgcctggaaccttctgcctggatatccacgtggctccctcatgtccctcaagcctttccactctctccatcttcacccccatccccgcaggccagcccccttcctctctctacccccatggactcggaacgcctgctggctgtgtgctccgttggttcccttgctcactggccgcatccccagggctgcccacatgcctcgtgggtctaggtgagagaatctatgccaggggtcagctcgttttttctgcgaaaggcctgagagtaaatattttcagcttcacaggccacccagtctctgtcctcactcctcaactctgcccctggggcccgaaagtgcctgcagacaataccataaggcatgactgggcctggcctgtgggttctgggctgccactccctgccctatggaaatcacctacttactgtgcacctactgtgtgccaggccctgggtgagccccccacacccatagatgctttctagacagggggtaaggaaacagaccaaggaaatcataagaaatggtaaaagtgtgacaaaagaagcaaacacggtgaaggggggacagaaatggggagacaggagcagggagtgggctcactggagacagggcagtctggggtggaaatgccagccttgcagccacagggcaagagcttggcaagtccaggagtgggaagctcatggggctgggggtgtctagggatatggaggggcagcaatgaccaagagcggagaggcagtggggaccacgcagagcctctgggcagggcctctgccgggcgggggtgcaccttattcctggaatggtagaaatgcagaacctgaccgggtgcagtggctcacacctgtaatcccagcaatttgggaggccgaggcgggtggatcacctgaggtcaggagttcgagaccagcctggccaacatggttaaaccctgtttctactaaaaatacaaaaaattagccaggcgtggtgacacacacctgtaatcccagctactcggaaggctgaggcaggaaaatcgcttgaacccaggaggcagaggtttttttaaaaaaaaaaaaaaagaggaaatgcagagccccagatcttccttgcacaagccaaatgcaggagggaccagtgaggggcttgcaaggggatcgggcccagggtgggggcagcagaggttttggggagtgggtgtgtgttttggagacggaatccatagcagtggccggtgggtcagaggcggggagtgtggcaaaggggagccccggaggacggtgatggcctccatggaaatgggcaaggctcaggggcagaggacaccaaaaagatttgggagaaatcacagtcaactcctagtgtcagtgcagagcccacccagcttctctgctgtcccacgaaggatgggagatataagttccatgtgggaaggtggctgagagcgggcagggcaagggcccaggccgggcagccagagtaccagggccggttcccagcctccttcagcctcagacacgccctggagtgaatggtttccatcggctgggagatggagtgaggctccttcatatacgtggggagcttgggggtctaagctgtgcagagcccgccagatcagtcccacgctgcaccacagggcccacacgtcctctctcagccttgctccctccctgtgtactgggctcccgcccttgcaagcccccagtggtggctacatggtgccaggagaggagtggcttgctgccaacagtgtgtgctctctgggaggtcccctgccatgagtttcctccccaggacctcacaggccccagggtcagccagcaggaagggcacgtccttggggcccacctcttaggacggtgggactttgacaaagtcatttcacttctccatgcccaggtgccccccactgtggagtggagtggattaccacacccacctggtaggatgctatgagcagcactgggggagacctgaaagacatcagggcgccgtgtggcacacacgcacatttgtcacctgtcaaaagtggcaagtcagcagggagtcctggaggacaaccagggccgtgaagcactggcagggtttctgggtacaagatgaagggaggaatcgtgggggtcctgcatggggaggaaggagcagggtagtggaaaggacagtttgtgcagggtgaatgtggggccacatcacaggagcaggcaggcacctctggacagcagcctggatcaggctgctgagctgggggtggaccagttgctccggccccatgggtggcagcctggagtgaggtcctggttcagcctgtgccctgggagtggcccttcctcggggatgctgttccctggtgcagtcttgttgattttgttcccagagttttgcctccatgggcaagttcctctgcaatttgggccttgacctccccatctgtgccttctaggagttggaatagactctgggccgggtgcggtggctcacgcctgtaatcccaacactttgggaggccgaggtgggtggatcacctgaggtcaggagtttgagaccagcctggccaacatggtgaaaccatgtacaaaattagccgggcttgatggcacacacctgtaatcccagctactcaggaggctgaggcaggagaatcacttgaacccgggaggtggaagttgcagtgagccgagatcgcaccactgcactccagcctgggtgacagagcaagactccgtctcaaaaaaaaaaaaaaaaacaacactctgcggttgctcctgggtcactggggagggaggcacagaggagagctggctatctcagacagtcccacggagcatcccgtgccagggtgagggggtagaggggctgcagggtgccggcagggtggaggggctgggtggctggctttgtgtgctccacacccacttccccatggcacagatcaggggcactgaggttcaggggatgaagtggcctgctcaaagccatgtggctgggacatggcagaccaggggcacagagccagggctgtgtggctcttggcatctgtcaggctgaagctgccccggcccacagaggagtgctcgggctgcaggaagggtcggatagggctaagtgatgtctgaattcctcacccgggggctgctcgggagttgcaggcaaccgcacacctactgggcctctagcaacagcagcaaacgttcactggatgccatgtagtgtccagtctataggggagacagcagtgaaaggcccaccccacacccttgctcctgccgttcctgcacctgcgggacttctattcagtctttggggcctgccaccgtggaaggaagggcaggaaggagggaggcaggagggagggcgaatgaacaatgtactcgaggagcagaggggctggcacggctgtgttttgaaacatgagaagcagaggctgggatgttccagggcagagggaatctggtgagccggtgagcaaagactcagaggcagctaagtgctgggcatgggatgaagggccatgtgtctggcgtggccagagccaaagaccgggcacacagacccaggttctgtccagagacagccagggtccagcaggagtctggagcagtgactgtaggacagaagcttgcaggctgcctgtggtgggccttctagaagcctcctgctccctctcggccttccctctcctggtaactccaatctctgatacctaccaggggctgactttggggaagtcctttcccttcctggggcctcagtttatcctctagtctgatggggcaggacttgaagagtccatcctgctctgatattcagcacctctgcgcttctctacttgggctggaggcagatcccgcccccaccccccaccacaccttcccctgaactacctgcccttcctatacacacacacacacagccaaagataaggaccagagccggggttctcctgaaagcccctggctagtttccaaactggctggtctctctaagacaggttgagagaggcgcctggagggagaggtacaggaagcacaggctttggagccagatcccatcctgcctgggccctgtgtcagaccccaggaggcagggatccctgcctgggggagctcaaaggggcctggggcctgcacttcctgggcctcgtgcagatgtgtccccacactaggaagcacagggccccagccttctcaggaagctcctggcccctgaggctgtgtgttgggtcatctcgcatctcctgagtcaaagcagaatggtaggtttaggaactcaggggtggggcaaggtgaagcctgttactagcccatgtcccagagaacagggtcctgcccttcctctcactgggcccctactgccaggtggagggtgggattctggtctttgaggcccatgccaggcagaggttggcctccaggctagcgctcctgcctttaggaggagcagccacaggttctgggagggcaggggctgtgtccagtcagtgtggagaccagcttcagcctgagacccagcctctgagccactattggcttcagttccaaacccactggggggtgggggcaggaagcaaggctgcccctctgtttcctggtccgcccagcacacacttttcctgaggcctactggtccgcccagcacacacttttcctgaggcctactggtcttcacagactcctcacaaactcatcaaggtgcccctgggaaccgaggggacagggctctgccttttatcccctcgggaaggggccagattcaataacaacactgcttttgggaaaggcattggccactttggactttattagcaacagtaatgtcccctgacatccgcacaagcttgtagctccacggccaggtcttcccccaacctcacaatggccccgtgatgcaggcaggcaggcgagtgggggtctcccctccttatccacaggccaccgaggcccagagagggccttgcccgaggtcacccagggagtggcttgctggagccctgggaataacagtcccacacaaggctctctccctccgcagctggacctgtacgcgggggctctgtttgtgcacatctgcctgggctggaacttctacctctccaccatcctcacgctcggcatcacagccctgtacaccatcgcaggtatggtgcctgcagcagggaggtccacccaggggacgtgtaaaggggtcagaaggccacctccccctacaggcccgagggagcagcccaggaagtggccccagcaggagccccagaagttcctccccgtgtccctcctccctggggccagggccccctccagcaaccttgcttccactggcagggggcctggctgctgtaatctacacggacgccctgcagacgctcatcatggtggtgggggctgtcatcctgacaatcaaaggtgaggacagagtctgtggccatggcggggctgtccccacagcgagccctttggagtctggcactgcccggcactgtgcaggattcatgccgttggggttctgggtagcatcgctgggagtgggtgggttcaggaggttgagccactaggcagtcagcccccctgctggcccctcagggactgccctggctggtagaggctacccaccctgctgccccgctgttaccagctctggccctggcaaggagctgactcaggaactcagggccagccacacccgcattggctcagcgcttgatggtgaggtggggctgtaggcgggtgtgaaggcacacaaccaggaggccataaaactgcctgggcagctcctccaattgtttaaaagcatgtacaaaatgccaagaggtgatgctacctcctgcaggacaaaggccagggaggaaagaagagagctgggagagattggcgatactagtctggaacagataggaaactcacagggctgcccggagagagcgtgagctcaccgtccctggaagtatgtaagcagagccaggaggatccctcagagagtgaacaaatctctaaagactcttccagactcagacactgggaccctgtggctgagcagtttctaacccttgaatggcacttgttcatttgctctgagcctcacacaaaccctcggtctgaatacagagcctgacctgagctccatgggaacagtgatgctggggagaccagcatccaggcagcaggctgcctcttccatgtcccacttggaaaaggctagggagtagggcctggggtggaaacgggttttcctacatccaggcttctccctctcagaccaggggctctagtgtccctgggacccaccgcatgagagggatcccagcagccaggcccagtctggaagggaggggagtgacacagacacagatgggccagggcttggccatgccgggccctgaccccgaggtagacaggaacagtgaggtgttttggactggagaggaaaaagccccggcttgagcccgccagatggtctatatggtcttggtggaggccccatccctctctggacctgtctccctcttctctgtgcctcagggggtggggccacatcaccaccagccactctcagctctgctaaaatcacacccttcaggtgatcaggatgaacactttagaagcctcaggaaggtcctcaaatgtcaagaaaaattacttttgcttccttgaatcgacaatcggaaacctggctgagaaccacttgcccaaggccgatgagtgtccagaggccaacagtgactcctgctgggccagcgggacactggggtgcccatgtgcaaaatgcttacttaatagtattattttaaatacgaataaaatagtcattcaaatacaccttaaaaaaaaaaacaaccctctaccctcacacctttccaaacactgggaaagatgaggtggaaaaaactcaagtttgatgcatcaggaagtttcttgtgagatgaaggcaggggggagcccagggagtcagggccccgcaaccaccaaactgtccctgttccaccctgacccctccagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtgagtgccaacgtctcccgcccatcccaccttcctgccgtcccagtgggctctggtaggcccaggcggcctgtctgccctccgcgtcatgagtctgggctggggcctcagaaggtgtggctccaggctgggacatgctgctaggggtctttgcggtcccggggggcttgagccctccgtttagaatccgatgaggcccactggctaccgcccgtcctggcctttaggtgcttcgactgagacagtttggagtatgggattccgaagggactcggatgctcctcggtggccctgccatcggtcatggggcgggcattttgggccagtcttgggctgccgggatccggaagcaggcggggtacctgacctcccttggcctgccagtggtgggggccagccatggctgggccagcgtttctggtagagctctggacgctgtcagcagcagagcggtacctagggggtcctgggaagccgtctttatccctagtccctgaggcagggaccctgtgatgatgaaactgctggccctgggagagagagagcagagagtgaggctgagcaagaagggccaaccccgccccagcacaggaccctgctcaggcacacaggagccggcaggcccgggttcgcctcctggctctgccattcaccagggagtgggcctagaccagttggtttagtcactcgatgcctcagttcccctgtctgtaatatgggaataatcctgccctttgtgggtgtagcaaggcagcttcctcccagctcacccccgcagcctcctctattccgacacaggcctgggacgtggttggaaatgggctgaatggggttgttggaggcaatgcaggagtttctgttgagtgcagggggtgactctggccctgccctcaagaccctgtcaccagccctccaggtgacctcagatgagctgcttcctgtctctgggcagaagcagatggtgcccttgctttgcttgtcccaaaggccgtgggcagctccagggagcatgggggtgggaaaaggcctgtgaagcagtgggcacaggccccacaattgtccatgcctctggacccagccccaggggtccaccataggacaaggcagccacagccagcctctgtggaatgaacgatcacagcgctcacacaagcctttcccacgtggcctaccctgggagtaggcccgaccagctccattcataggccagagcactgaggccagagacagagctggatccgaacccagagtggagtgacttttccgtggttcccgactctgctcttcctctcccaagcagcacgggctccatcagtatctgcccagagaccctccctgggttccaacagtaagaacggacctggccgggggcggtggctcaagcctgtaatcccagcactttgggaggctgacatgggcggatcacgaggtcaggagatcgagaccatcctggctaacacagtgaaaccccgtctctactaaaaatacaaaaaattagctgggcacggtggcaggcgcctgtagtcccagctactcgggaggctgaggcaggagaatggcgtgagcccaggaggtggagttgacagtgagcagtgagccgagattgtgccactgcactccagcctgggggacagagcgagactccgtctaaaaaaaaaaaaaaaaagaacagaccccaactaggagctatcagaagctctggaaggctgggcctcagtttccccatctgtaacacgtggtcctcaagcagggcccctcatgctccggcatgctgtgctcacaagctgcccacatccgccatgcctcatgggagggctttccagggaacatgtgggctcacagcaggcgtctgcccagttctcctgggagggctgagggccagccccagtgggcaaggggctggtgaaaggttggccgtggagggcacagtaggcaagtggtaccctgccaggctgagcccctttacacccgccacctcccacctcctcccaatgcagcatgggcttggcatggcacggtcttctctgggtggaacatcagtcaggagattttcccatcaaggccaaacgaatctgcacatgtcctggccttggggtcagggttgggcaggccccactgcacagataaggagcccgaggcccagagaggatcacacagggaggtggaggaggaacactgctgaccccaggtggttcaggacaccaaccagcattggagctgtagcctggcctctgccctacctccccatcctctaccccttgggctgggtctgcctggtggatgcggggcctcggtccagaaacccaggcactagtcctacttgaggttcctggtctctgtgtggctctcactgacactggggacttttaggggcacctagaggtctgactccactttgctctgtggccagggtagccctcaaagatagccacagtctagtcagaagggaggtagcagttctgtgtgttgagaccataggggtgttttgcttttttttaagatggagtcttgctctgttgctcaggctggagtgcagtggcaccatctcggctcactgcaacctccgcctcctgggttcaagtgattctcctgtctcagccacccaggtagctgggactacaggcatgtgccaccacactcggctaatttttgtatttttttttaagttttttttttttttttttttttcccagagacatagtcttgttctgtcacccaggctggagtgcagtggtgtgatctcagctcactgcaacctccgcctcctgggtttgagcaattctcctgcctcagcctcctaagtagttgggattacaagcgtgtaccatcatgcccggctaatttttgtatttttaatagagacggggtttcaccatgttggcaaggctggtctcgaactcctgacctcgtgatccgcccacctaggcctcccaaagtgctgggattacaggcatgagccaccatgcccagccaatttttgtatttttagtagaaatggggtttcaccatgttggccaggctggtcttgaactcctgacctcaagtaatccacccatcttggcctcccaaagtgctgggatacaggcatggaccgttcactatcttctggctcatccatgacaagtaggtggcatttttctaaccagaaacaaaaccagtaacaaagaggcaaagggtccagtggacagagccctggtctgggctcccgtctgggctatgcccctgcccctccctgggccttggtgtccctgtctgtgaaacagggcagtgcacagaccagaaggcctcccagggtcctgccagctctgtcacctgctgatgccgcagctccaggccgggtgccctcccttagtcagtagcagccacctcagtcataacagcaaccacagctttcgtgggcagcgtgctgactccaatggccacaccccaaaactcactcatcatcttccctgagaaagagaactcacattcaccggaggcccttgaggagccagggacaggcttggccggctacactagcagcctcacttaagtcgttgcaacaactctcctcattttgcagatgaggagcccaaggtgaaatggccactcagggagtgagtgccggcttcctcagggaagagcgcctggctgggactagacaccagtgctgggaggtgggggtgagcagtggcctgctgacatctgagttgggggcccagccttgctatctgacagtcaggggtggggaaagcccctgccctattcagggggactggcaggcctcacagctcatggaaactctgagcctcagcttctctacttggggtgacagcacctgtcccagggccagctgacatgagcacagattggaatatagaggcaaatatcccaccaatggcaaaaagacattcagggtcttagggaaatgcttctctcccaagcacctagacagaaccaccgtctaactctctcattgtccagatggggcaactgaggcccaaactgaggcaagggcttctcccaagtcacagcaagctggcagagaagcaggaaggacagcagcttgccctgcgttcggaggctgcagcccgcaggcattcctagcctctgtaattaatgtttccgtgacatccacagcttaggggtaaatgctgggagccgtccgttaaactagcaagcttggaaagtaagttaaaatcacggaggcagccggatgcggtggctcacacctgtaatcccagcactttgggaggccgaggcgggcagatcacctgaagtcgggagttcaagaccagcctgaccaacatggtaaaaccccatctctactaaaaatacaaaaaaaaattagccgggcgtggtggctcatgcctgtaatcccagctacttgggaggctgaggcaggagaatcccttgaaccctggaaggcagaggttgcggtgacccgagattgcgccattgcactccagcctgggcaacaagagtgaaactccatctcaaagaaaaaaaaaatcatagaggcttcctgctcctgagttgcagctggtgacttaaactgtggaaccgcaaaggaaaactagttacgtttcagagtcataggtcgtacaactttgtgaacgtactaaaaaccatgggaacagtgtacactttgggtgaattatatggtctgtgaatatctcaataaagctgtttaaaaagtaactcttttgggctgggcacggtggctcacgcttgtaatcccagcactttgggaggtcgaggcgggcgatcacgaggtcaggagatcaagaccatcctggctaacaaggtgaaacctcgtctctattttaaaaatacaaaaaattagccgggcgtggtggcaggcgcctgttgtcccagctacttgggaggctgaggcaggagaatggcgtgaacccggaggcggagcttgcagtgagccgagatcgcaccactgcactccagcctgggcgacagagcaagactccgactcaaaaaaaaagtaactcttttgaagtagaatcgtaatatcagtgctgggagagatctcagacattatgggtccaaattaccgctccctcctcccattctgcaaatctggaaaggcctggttaggatttgctgaaggctcccagaagggccggtgtcctcagatagcttctagcctccctctgctactgaactgcaagctttcaaaaccccaggtcttaaagcacctgaactctgccagccatgcaaacacagttggcgccagtgtctgctcctggcactataaatgtgccagctgctgtcatgagggtccaggagatgagggtaggggtgtatgtccccataccaccccacccagggtctcctccagccctgacaattgccaggggtggtgggctgggcaggatccacacctcccctattgacaggtcaggggactgagtccctgggaatgagtgtacctcggctctcgctgcttggcctgctgaagtgagctctcctggtgggaccctgacagtattggggctttgagtgtggctgttttgggcaggtcagaggctaatgggacatcatcgtgcctcatgcccattccctgaggcccaccaaggaccaatcctgacacaagtgtccctcaggcttggactcaccccgtctcgcactccacccccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtaggacgggctccgggcactgaacccaggctgcagggcacccagggttctgggaccttgtcctgcaaacgtcaccagaagaagaggcaaaggatagatgtgaactgttccccaacctggggagtggggagagtggtcctcagggccacaatcaaagggattaacatggatgtggcttggcacaaggtctggacaggtatcacttactgctgtgtgacctcaaggctgtaaatgaacgtccctgtgccccgccttttcctcatctgcaaactagggactgtgccacccatctggcaggtgccatcaagatcctctaaccacaggctttggagacctctaggtggggaaacgtgcattttcttaggttgccttttcaggatgctgggaccaagagtccccagcattaatgatggccttccatatggccctggccggttcccacccctgcctgttcatcaagtttccccatctgtaacaagggaattgaagtcatcagagtcagggacatggtagcccagaagacaacagctcgagctcttgggtggctggcagggagggactcgtgacccctggtgtgcagggaccctgacccacctgtgcctccttgtctgtggagcgctgggcctgcatcctcttcaacgcatctgcttcttctcttccccgactctgggcccatggggagccaccctggggtccaacaaaggtccctcgggttatatggggggcactcagctgccggcgcggtggtggggttggcccgttggccacttgctctgagtggcgcctccggagagggactgagtgctctctcacctcgaagtactcctctgacacagaggaagccactgagggccgtcgggggccagggccacggccggagctgcctgagtggctgtcctggtcactgagggttacgtagtcgtcatcatcttcttcttccaccccatccagcccattggggagccccaccccgaggctctcggggtcatcctgggtcacagatagctgccgctggagtggggcgtggcctgggcctgccatcctgggtagcctatggtctgtcccattctggggagcttcctctttggggagctccaggacccagccaatatcactgctgtcccgggctagtacatctgccacagggactgtccggggcttgggcacggggggcaatggctcagggtccccctgggggaggccgttctcagctgggacaccgtcctggggggcactgggctctgggggagggcaaggctctggacggggcctgctgtcctggctctgcttccacagctggtgctgggcgctggcctgggaggtgtcacggatcttgatgcggttcatctggctgggctgggggttccagatgttggggtcgatgatattgatgtagcccaggatgtcgctgccaggctccgggtctggctccacccacgtgggcaggtactcaaacatgttggccctctccaggtgaagcagtcctgggtggatgggtggcagcagctcggggagttcccctggatgctcagccagcgctgggcctttcagccccaggggcttcttggcctcctgcttctcagaggagatcttggcaatctcgtcgacgctcttggccttgacaagtgcgtacttggggttgacgagcttcttggccacagtgcccgcgggcaccagggggaccacagagggcagcacaataggctccggctccggttccttctccatagggatgcccttgaggctcacactgtgtgacatgaggtacagctcctggaactgccggtcaaacatctccaccacctggccagacagcacagagatcacattccggtccgtccgcgcggccgaccacgtgaagctgcaacagagggagggggcgctggtcaggcacatgaccctgcttcctccgcccagcccccgtgcacccatagccgctgggcctcagactgtggccacagggccctgggatcaagaagtgaatgggggcagagagcaggtgcatactgtggggtcagactgagtcggatgtcaagcaagttggttgcaccaagcccattcccacctctgcaaatgacagggcactgtgctcctctcaggctggtacaggattcactaagcagctcaggaaggccctggacactgtggggggttctgcatgtggtggccgctgctgccatgcgtctatgctgccaccaacccccatgtaaccatgggcagcgcccaccccatgccccatgtggtggtgcccacagagctggccccatccctaaggacggctctcagagtgacccccataggcttgcgaaggcacggcctggccacaccccacctccaggccggtgacatctccaagctggaacaacagcgtcctcagacaaagcccttctctgcctgcctccagagacagacaggcgggcagatgtgctccagccctgcgcacacctcagcagccttgggaccaatgaaccggaataaccagggttaggattaagggcagaagccagttgggagccagaggtacctctcgcacaacttccctgaaagctggagagtcacctgtaggagccgcacacagcccggtctccatccacaaacatgaacttctgggccagggcacccttgaacttggttgccgaccgcgtgaagaactcagttcccccgctgctccgcactctgagattctgttttgggaaccaagagacagaattacacgactgcaaccctgaccacacagggcgaggggaggacggcagctgcccagggctcagaggggactctggagtagtcaggaggggaagaaagaggctgtaaggcctggagaaaggggctggtgtgtctgggactgcagggctcagggtaaggagggagctgctgagccgtgaagctacagagcgggcaggcactggtacaaaggggttggcataagatggtctgggctttggccctaaaggtgtctgaagagcagcatcaggcaggaaaaggcttacacagccagccagcttgggaaatgctgccgtgggtggtggatgctatggtggggtcctgagcgggagggtgatgtgcacacgttttagaagtgtctcgtggatggctagggggtgatgcagccagaggagggcaggaagggggcctgccctgcagaatctgtgccttatactccgataagtctgtggccctccagggtgcgtggccctacccggcctctcccctgtgcttctcaacacccctgtctctgctgggctctgctccgaggacaggactcacagcaaacctttctccttccccatggccaggacaccacccagcacccaggccaggtcctgtaaatggtcagagattcaattctgtgccggcttacactgtttggcccaggagcaggccaggaaggccctcagagactgtggccaagggagctgagacccaaggagaagagggctccttgggcatgaggagcacagcgggcccctcaactgcctcagctccaaggccaggtcgtcaccggccttttcctggaccctgaacacataagggccctctgtcccagtgtggagtctctggagctgccaagggcctgtgtgttatgagctccaggtgctgacttccctcccccaggtagcaggacctgctgtgagggaggagcagatggtaaaggctggtgctgggcacggcagaccccaggaaggacagggcgagcctggctggaacccaagtgtcgaggatggccaagggcatcccgaagtagaatcacaggtgtaaaggggacctggggctcatctggcccctgtctagggcagtgtgtaagaaatgctcctgggtgccctgagggtctgactcaggaggcctgaggtcaggcagggaatctcagttttaacacccactccagggattcctgactggtctgcctgcatgcctcctgtgatgggagtctcactccctcccgaggggctctgtgccggcttctggctctcggctatgacgtgttcttagtcaggctgagctgtgacgtactggtctgtcccctcacccactcactggccccagcttattcaccccactcattcacatagtcatcaacccctgccgaggcctccagctgcagagatgcctgtgatgaggatcccacctgggaggtgaaggggaggctgagggggtaaacgaaaacaagctgaatgcccaggatcgcagaggagtagcctgaagtgtgaagggctggccgggaggctcccgggagaggatgacataggtcacagggggaggtggggaagcattccagggaagggactcaaagaccaggcatgagaggcctttgtacaagagcacctcaggggaggaggggtgggtgatggagcctgcagagcgagcaggggcgggctcctggtaaaagaccctgcaccggcttaagagcctgagcttggccctggggccagtagggagccatgggaggatttacagcaagagcgatggggttgggtgtgtatctcaggagcagtgctggcatcaggcagtgggtgtgtgaggtgaatgctatgggagaggaggggagcctgagagagcagagctgcccgccatgccatccagcctcctgccctgccagtcctttccgtgtcccagacccctgtggctggggtggccccaggcaagcaaccacagaggcaggcaggtgtgggccgtgggtgagtccccatctgatgcccacctgtgggataaaccatagccttttcatagggcccagtgcagaaggcagataagcctctgctcccagggccgccctcgccggccccccaccccgcaggctgcaggtttgcacacagccagctcagcaggaagctggccacggcccaggacaattagcgctcgtgactttgtacccaacatggagcacgctcggggttgagaagtcggacaaagatcctggaggtggtacgaggccttccctgtcactgagcccaaccgagcccagctccaccgcctcctgcaggctcctggcccggccacagacccctccttagcctggaaaatcggccgccagcatcaggacccttctggacagtgtctgtccccacccatcccaaaccttgtcctgatgagggctcggaaagtcaccacttccatctcagagtgactcagcctccgtgtgagccgcaggcctcggctgggccgctgactcgctgtgactcgaagcaagtcccgggcccttgctgggccttagtctcccttagcacacagcagggcgggcctccaactcttaggcctgttctacctggggctcagcagcaggtgggggcctgcagcagggccccccacctcttgcctcatggcctgctccccagcttgtgcctggatgggccccaccccacggggcctggcctggatgaggtaacgtctcaagactctgggctcgtgtgcgcagaggtggaggatcccacaaagctgcattgtctctgagctcctgggacacccccggcacaggacagcagatgggtggagggatgccggggctggcccaagaggggtgccctggaaaagtctttggaccctctgggacctcagtttcctcataagtaagagaggacgtcaagggcgagtcagggcaggggaggacggccgggtggtgcttcatctgctctcagcgggtggcaaggcaaggtgggggctccagggctggggcaaactacagcaacctgcccccaatccccccaggcctccaggccacatgtgcttaaaggacatgtgatccaactgtgccaagcccgctggtgcgaggcagagggggctgagcccaggagcccctggagtgggtctagggtctaggcattcctgagctccagtcaaacaggctccaatcctagcaccaaatggacgccaaccaaggcctttctttccacgcctcagttttctcatctatgaaagggtctactcatccttgtgctgcaaggctgctgtgaggactgaatagagccacagtacaggtggggccctcccagggaaggtgtccagctcccagtgggtgccccatgaactggaagtggcgcagtgggctgtgggggaccaacacagaggaccacaaaacatccaggagggatggactgcccagggaggccaggactgtcagccgtactgggtgggtggttggtgggctcaggtagggaaagtgacctgcccactgtctcccagtagccctgggctgggccgggactgaggacagggctctttcatcacccacctcctcagggccctgctggccaaacaccgtctcctttaatttcaccctcacacaaccccgtgaggcatcactatggccatggggcgctcgaggcccagagaggtggaaccacacgcccaggtcccacagcaggtcaacagccagtgagccatgtaggcagcaccaggacagcctgtgctggcaggttagctttggttttggttttataatggaagccagtgattacttcccctgcccatagtgggatggccattcctaggtttattgatagttgagtagttagtgtgaatgagtagaggcccggtagagcagtggggaggtccagagatgcatccttgaccaggtctgagctgggaacagtgaggccaggcctagtgtgaggaatgcaaggaacagagcccaacatagcagcaggagcctggctgcctgaggtgcaggcctccagcagcctctactctcctctacagggcctgtctcgctctctgtggagggtggagaggggtggtcaacactcaccctggacttctccaggctgttgtgaagttggggtggtgggccctttgtgaaccacatttggcccaaagtatgtgacggcatgtaggggcagggccagcctagctccaaggccctggtctgaggggctcctctctcccctaggccaaggctgctcagcctctgcacaactgatacatgtccccttttgtgtgggacctgtccccggcagtgtaggatgtttaacaacatccttggccactcaatgctggtagtacccccaaggtggacagttaacaatgccaaatgtccctcagcagagtgaatcccccccgtttgagaacccctgccttggccgggcgcggtggctcacgcctgtaatccccgcactttgggaggccgaggcgggcggatcacgaggtcagcagatcgagaccatcctggctaacacggtgaaaccccatctctactaaaaatacaaaaaattagccgggcgtggtggcgggcccctgtagtcccagctactggggaggctgaagcaggataatggcacgaacccgggaggcagagcttgcagttcacgccactgcagtccagcctgggcgacagagcaagactccctctcaaaaaaaaaaaaaaaaaaaaaagagaaccctgccttataccctgaatccaccacagacccaggcccaggtagagacagcaagcaacacccaggcatccccggggaacgggggaacctgggcagcggaagggctgggtcgtgcctgtccagcgtgaggcctgagcggcagcgatcctcacttcctcaccgtgtgccttcccatggccatcccagctgatgcttctttgttcatcagaaacgggaaacgggtctggcctttgcccaggggctgctggtatttccagtttggctgcacgaagtcaactggcttttcagatggcccaggcatctcatggctcttgtctgtcctaagctggaagcctcaggcccagcctgtctctggttggcctgggagcatccctccacacccagtatcacccccaaaagcagccaagtcatgcggcctggccctgtgaccctagagggtgtcagtgaaagttctggccctcttcccaaggcctgctccctatttgtcatttggggtggtcattcccatactcccacatggagggccactggggccggccagggcaaccggctgaggtgcttaggaatggctgggagccccacatttggggagacactggtgcacgctgctcccacctcacctggggaccaggagtgggcttggcccaagcaacagggcagcgtttcgagagtgtgttggtgtgggctccaagctcaggaggaaggagccgagtgagggtgaaccacagccagaccctggcgcagagggaaagaaagccgctcagcactcagaccagagctgcgtctcatggcggggctgtgcctgtccctagccaaagccaggatgggaagggagctcgtgaccgaaggcccaccgcacaaacggcctccttcactcttcacagcacccctgacagataaatgaccatgtccccattttgtagacaagacaatggaggcctagaaggattcagtgactctgcccaaggttaccatgcaggtggcacagctggggctcaggactggctcctggtatcacccccaaactggcacctgacaccccaaggtcaaaaggatgaccctaccagaaaacctgtaccctgcctgggcccaaaggagctggggcaggttggtgcagagctgggcaggggtggcagtggctgagggcaggcccagggattatcggcaaaggaagtgctcccgggacaggtctgggcccagctagctcaaggtgagggaggtaggcagggaaggcaggccctcgacagggggtgacacttggctggggctgggctctcagggcctctggccacccgcccagggctgtagaagggcaagctcagaggcgagaatgaggaagccaggtcacactttcccatggaggcgtctagctcctggatatgtcaccctacagactctgccaccttccctggggaagcgaggcggctgagcagggcaggcggggccagggacctgcagtgccagctgccttccagctggtcacagccagtggaagggctgggggtggaacagggcaggcctcatacccaagcccctaccccagcccagggcctgggatttagaatgtgtggttcttgccagtagctgtataactttcctcagcacacacagcactttacaaccaccgtctcctttaatttcaccttcacacaaccccgtgaggcatcactatggccatggggcactcgaggcccagagaggtggaaccacacacccaggacccacagcaggtcagcggccagtgagccgtgtgggcagcaccagggcagcctgtgctggcaggttggctttggttttggttttataatggaagccagtgactacttcccctgcccatagtgggatggccattcctaggtttattgatagttgagtagttggtgtgaatgagtagggtgggagtgctagaagattggttgagccaataaaaaggataagagaaattaatataagggatcaagttcatcctttgatgctctgtgttattatttgtagttgtttattatttgctgcttgagtaccagggatctgcagcctccttgtcagagctgatttgtcactattggcttttaggcgccacccctaaattggtcggaattgctttgggcaaggcatggcctccctcggatctcagtttctccatctgtcttgtgggagcctcatctgaatgacctcaaggccccttcaggcccaggcactccaggccccccacctgccccattgcctccggcttcctggaaactcagaactctgcaagcagcggagcagccagggcttctctgctgagaaggggcctgggtggaaggcgaggcctctggagtggctggccccaggttagggtccctgctccaaaccgacaggcttgctccctgcttgcgtctgcacgctgggggaagtgcaaagcactcgctgggcctggggcaggggtacggtgctggtggggccccactggggtctcttcctgggcatcgggcagggccaggccttctgcagtcaggtttccaaagtggcctttccacactggctctctcaggcatgagctatctgccactggaatcgattcccagcactaattacgcggcggggagtgaggtgggtgtggggcttggggccaacccaccagggagaccacattaaaaatgtcccaagagctagagactcaccacggagtgctcacaaccacttgaaaggactcaaccggaggcgttggggttggagggggtgggcgcgcctgacaaatgctgacaaattacaggcgtggagcccggccccttgttaaccagactggcggtgccccttctcctaggaccacaagcctgaaacctgcagaattttgacctgtcagacactggtgctgagcccaagggtctggagcaggcctctaccccactatctttaacttgctagcagtgacatggggtatgtggctccattccctcatctgcaaaatgggaacaactccctatcccactaggctgttgtgaggattaaattaaccaatgcaaagtgcctgtgacagggcctggcgcacggccaatgcaagagaagtattcgccgtcatcacgcacgctcatctgctctcagggaaatgctctgcacgcagcaggtgccaagcgatggctggcagaaggagggctccagacaccaaatgccagggtgtctgggcagaagagcgttggaccaatgagatcctgtagcccagagaagggaggtgacatgcccaaggacacacagcaaaacagtgctgagaaccacagcccaccctgaccccatcggcagccttctctgatccacttctgttccatggtttcccccaccccaaaggttctttctcctctgctcttgtgccttaaattcacttcaactgtgcagccatcgcagaagccttccctggccccagcctgagggagcttcctctgtctgagccagaatctaaaaccagtaaatggaattctaaggagacagatttgggcttaacccaagaaaggacttcctgggagttgaagctctccagaaaggccacgagctacctgaggaggcagtgagcacactatcaccagaggtatgcaagcaaacagataaccgatgtggcatgggctgctctgaaataacatgatgcagcacttggcatgagctccagcacctggtcagcaagcacctaatcagtgtttattttatctctgccacgttggaggtagtgagtatcctgcccctcagggaattcaagcagtggctatgtgactgcttggcaggaggctctaggattactggactctgagtgcctggcacaggactccgtccagagcaggcaggtactcgaagtgtttgttgacagactgaatgacccctgccctccagccacccaggcaagtgaggagcctgctcaccttgaggtgccccaggtgcatgcaggcccgctcacacatgtgcaggaagtacttgacgttactctcatccacgatgatgtacacggccactttcctcttgaagccggcgtccagcaggtccttgaagatgtccacgtcggtgaacatgtccatgaccacagctatcacctgggagcaagaagagagactagggcctgtcagacagtgcagcagtggggacagggtgccctggcagagcgcacagccctcccatgccaccagcctctcacaggtgcccactctggccctactcctggagcctcaggcccgggaccaggaagtgaggggccaggggcctctcttgccctgaagttctagttgcagtcccagctctgggctcagcccaggggccctgtgttggtgcattcccaggccagggccggctacgctctgccctccttgtaacacctgggaatgctgagatgaacctgatgtgtcaatgaccggaagggcagcagctggcgtggcggctcgctggggcatcccctacattcctgggctggtgtggactttggccagtgtctaaacccagatctcttcctgtcagctgacaacatctgtccccatagcaggtgacctcctgctggacctggctcagggtggggccccagtggtcagggccttcccccagcccagccaagcaccaccaacagggcagggggcctggctgagtgaaggtgcaaggtggaacatgcagaaggacaggatgaggtggtatgggcccggccccagtggggctcagtgactgtcaggcttctctcacacctagtcccctccctgtcccttggcagcaaggggagggagtcaggacagggcctgtgcctgggcacagccgcctacactgctgatgcagacacatgtcccacttttgggcagccccacccctcccaccctccgagcctggcaccaccatccctgtcccaggtctgaggaccacctggagaagaggccagggacctgccctaggccacacagcaagctggggacagagtcaggctacagactaccctgacttgtcagagagcaccccagccttgctgggatgcggagattcagggtggtggaggcggcctggagcctgctggggatgtgtctgcacgccccaaagtgagctcaccaggctggcccctgcaggcccatctgggctcctcctgggcctcaggcccccatcgttcacctggcaccaaagcccaaactccagcagaggggagggctccatacctgccctgcctcaaactcactgtgtgaccctgagcaaaacacctggcttctctggacccagttttctcatcagtatagcatgctccatctctcaggagaatggagcacacctgaataccgcagcacctgcaaagagcccgacggggggctggggcgggggctcggtgatgcccgtttgctgcctttctcccacagtcaccccgcacgttcccatttacagggggtcttgtcagcctgactcctgcagcctctcacaggcaccatggtggtgacagcccagcatgcagccaggtaaactgaggctcaatgaggttgtaaggcttgttggatgtcgcaaagcaagttgggccagggcctggacctacctccgagtcaggtcagggttggtctccagtaccttctcttggacgtttagtctcggagagcctgggagagagtggtccccccagagcggacagcggaggtgtgggaccagctgggactcccagaactccaaggcctagggttctctctgttctctggggagatgactgctccctatctctctgtttctgaagggctgttttggggcagagggagtagctggttgatgcagggtctacgactcgcaggggaggcagatgttggcaccagatggggaagcacttgctgcccccagggctgcccaaggttaaacagggatcttaagagggagctcactccctgacctaggagatgttcaaggaaggccagagactgcttggagcgggggtagatgatagggcagagaagacacgatgcaggcaggtcaccatgaccctggaggcagtggtgttgagacactgggcaggggtgtgtggtggtagcagggtcctccctgcctgggatctcccagacccaaagcctctccagccccagaatctccttagttaagccacttctgagcaggcaaacagcctcacgtgccaccctggaaaggagcctaatgagggcgcagtaggcatgcttctccctggagggcaccaggccctgcctaccgtggcagatggggacttgccctgggcttgggctgggggacgtgccccagcaggacccgcaccatgtgcgccactccccacattgccctcagccaggcagggtgcctgatccagggaccatctgctgtcaggttggatatgttggagcctgcactccaaaatggatccccccacagtcctggctctccccaggcattgggttcagtgcctagggtggtcagagatgggtttgtaacaggcacgagcttatgctggggatggggagggggagcctggtgctcccccaggcaacccccaacagcctggcctgtccatggagccacaaaggtttcttgggggcccttgagtcctgtcatgccctttcccattttatagacaggaaagctgggatcacagtccatgactgaggctagaacccagggccctgtcccacccagagcaccttctgcacaagagactgggcatcagtcctgggcccttgagctgcttgatggtttataaggagcctttacagctgttaccttgttcaggcctcacaagcacaccgggaggcagtggttctttttcccattttgcagataaagaaactgaagcacagaggcattcgccaccttgcctaattctgttgggaggcccagctcacttgtgacaccatgagctcagcaagagcagagcccttgtctgagcccaggacggggcctggtttaaggaaggtcctggggagcttttatcaactgagaacaagaccaactggcttggtctgggaatgactgcaggaatcagggcatctgggaccacagcccctcctgggcccttggcttccccatctgtcaaatgggggtgtgggcctggcttgcccctgtggttctatccagttcacacattgtcagagctggcccaagtcaagaaaagtaccagatgcttcacgtagccccaagcccacacgtcctctcagaggtcctgggcagggcaagggctgtggaaatgagaggggaggctgactccaaagaccagctctacctgctgttatgtcaggggccacactgggcaggaggcgggtggcctgggtcccatcactgagcttgttccgctcctgaggcaggaaccagccatgtccatgtgagcagctggcacaggggcaggcatggcaggcgggcacgtgtgtgtcctgcaccccaggtaccgttgtcaaagccgacgggcagctcccagcccagcagcctggaatctgcgcaggccacacagcccagctcccaagtgaaggagggagcccagtggtccctgtgcatcttactgatggacaggcctctgctgggcggccttgaggcctcgaagatgcagctgcagaacccaggaggcccaatgcccaagacaaccatctgactcctgccagggtgtgggaggatggcccaagatggcagggtgtgggaggatggccatgcctggggggcagaggcaggcaggctgcactggagggaaacaccagcagggatgtgggcactcctccagtgagccaacagcgagcctgcgcctgccccagcccaggcctctccctgggggctcctggtgcccaaacacctccggcatgtctgtccaggggtgtccatatgcacaagccctccagcgccccgcccgatgagcacctcctcccatgctgtaccctccctgcccagtggatccgccggccttctccaccctgccttctgcctgtgtctcgaatcccccacctccctctgtgtccttgggacagggggacatccgcctccatgtgagagatgcagaaactgcagctgggagaggggagggcactggtccaaggtggtgctgcatggggatccccagtgccctgccaggagcacctccaacacctgggcagtgaccggagcagcttgagctgggatgcaggggtgacagcatctcacacaaaggagaaccccacctgtggccactgccccccagcagacacggcctgaagccacgtaacactggctgctggcgttgggggtgggacagggctttaggtcacagaggcagggagcacaggcgtgggcctcctcaatctccctcagccccagccagagccccctgagcaagggtggagcgggcggagtcggtccagcaccggcgcccaagctctaggctgggctttgggtgagccacacctgcgttccaggtctcagtttcttcacctgtcaaaggagaaggtggacaagatgtccaaggcccttcgtctctgatgtccctgccgagggaccccaactcctgttccctgcctggtgccgggcagggcctgtctgggcggctaacacatctcattgcgcccacaggtctgggagaggaagtgctggtggccgccctctccctgcctccccacacagctcctgcctcacaggtgccaacaacagcctgtggctcctgacacccacaacagctgtttcctagccttcctgtgaccacagaaccactcttgaagcagaagtgccctcgcaggacgagtaggtagaacaggtctccacagaggtgcctggggaggaggggtggggcgagacgggctggcctggttccgagcatggtgggaaaccacgggtgcacaggcccagcctctgcagcagcacctcttcaggggggccctaaaccaacgcatcctgacccctctccccgacgcttcctgatccctctccccgacgcgtcctgcctcaagccactgtgtctcctacatgttgttctccttgccacctgcccattttgcatctgctcggacaactaccttttttcaaatcccaactccagtgcagccccagcctcccctgtcgtcactctggcctgtctgggttgagcgtgtatcacttgcgtatttcttctcaggcacagcaatggagtctcccaaggactgagtcgcaagactcgggtaagaggggacagtttccaacctgcacgtgacaagccttacactcacctcaccctcctaggcctcagagatccctagaggcggctcagagagaggagagaggcggccatattctctctcctcactatgctccaggcaggtggaggacagataccctcaagcctgccccagaacctggagccctgaagcagccacagacactgcacacactgcagacaagtccctaggcctctctgggcctcactttcccacctgagaagtgccgggggtggacagagtctctcatcttggggttcgttattctccaggtctgatggcagatgcccagacagtggcagtgtgggctctgcacccgctggctccgatctcagctcctcctgggaagctgcatgaccttgggcaagtaccttcatttcctcatggggataataacaatccccacccacaaggttgttggaaattaaaatgaattcatgcaggtgaagccctagcaggggatccacaaacggcagctgcacggaccctcctcgtcctcccaccaacccaagtcccatcccaccagacccacagctccctctggggtgaacaggccagcagcgtctcactaccctccgggccagctggaaggctgtaagtgacgcatcagggctgctcacaggaatgctgcagactgtcttaaaggttgaggcagtggccatcatgaccttggattcaacttccacttacagccatgatggaataacagagacggaattcaccccctgccttagcaataaaaaacccggataaaatctatgaagccatggacaacaggcttcaatcagcacagcgattcctgagagaagaggaacaaaccagctgagccctaggatcaccccactatttccaggctgcagcacagggaggggcgcccccgtggagtcttgtggtctccctgagttgaggagacagggttcactctgagtgtagcagctaggatttgcaggacggagtgccgcaggggagagagctgcacagagtgaactccagagacctgcagagggtcccctggagtcttcagctgatagccgagcagcacacgaacgtgaggaaactactgaggctgagcagggaaccactggaaaggggaggctgagcagagaaccaccggaaaggggtggctggaacaattgctggtgctcacgcaggaccgggaatagtgtatgtgcccccagccagaacagaaacccctcctaacacacaggtcctgcagggggtgtcctcagaaggatactgcctcagcagttgacaaataagtcctagaccaggcataagcaaacttcctgaagaaccagagtgtagacatgtgaggctttaagggccatatgttctctgtcacaactactcaaatctgctggtgtaacacaaaagcagccaaacaaagtatataaataaatatctatgttctattgtttataaaagctggcaagaggcttcctttggcctggggtccataatttgcaactcctaccctggagtgaagtctgctctggtcctgcctaataaagcttgacaggaagccacaaaagcattaaatcgtttccaagtaacctaactgcatcccagaacaaggctccaaaatatttaaaggagaaaacaaaacaaacaaaaactacaaactaaaatccaacatgcccggtatccaattaaaaattaccagacacacaaagaaacaagaaaacatgatgcacatgagaaaaaaaaatccatcaaaatcaaccaaaaaccgacacagatgttagaactggcagataaagacataaaaacagttataactgtgttccatgtgttcaaaaagttaggtagagatgtggaagcttttttttagccaacaaatcgaaattcaagaggtgaaaatgcaacatttaagacgaaaaatatactaggtggaattaacagattaaacactatagaagagaaaattagtgaacttgaagacatgtaagtagaaactgtccaaaatgacacacagaaagactgaaagaacatgaacacagcatcagcaaactgtgggtcaacttcaagccatccaatatatgtgtaattgcagtctcagaaggtggaagggttgggagtgagcgagagactaaaaaaataaataaataagaaaaaaatggccaaaacacttctaccatttgattaaagactaaatccaaggcaaggtgcagtggctcatgcctataatcccagcactttgggaggcagaggcgggtggatcacttgaggtcagaagttggagaccagcctggccaacatggcaaaaccctgtctctactaaaaatacaaaaattagcagggcatagtggcatgtgcctataatcccagctacttgggaggctgaggcaggagaattgcttgaacccaggaggtggagtttgcagtgagccaagattgcgccactgcactccagcctgggcaacagagtaagactctgtctcaattaaaaaaaaaaaaaaaagactaaatccacaggtctcagaagagacatgaaaaaactataccaacgcacatcataaacaaatcacttaaagtcagtaacaaagagagcgttaaaaacaaccagaagagaaaagacaactgcatgtcaaggaacaaagtaagtggacttctcatcagaatcactgcaagccacaagacaacaggcaatatctttaaagtactaaatggaaaaaaaaaaaaatcaacttagaattttatacccagtaaaaatacatttcaaaacaaaaggcaaactaaagactttttcaaatataaaaaagctgagagaattcattaccagcagacccgcactccctcctccagctgcaaccccctcctccagcagcacggttgggacagacgtggctgcagcacctcagtttttctatcatgacatggtcccactccccctcccctcctcctcccctccagggggctggcagaattagtgacatgccatctgaagaggcccaagaaggttctctgggttaggaagttctcctaggatccctgggtggtgctccctgccacctcctggcaatctccaaaccagtttgcccatataatgtctctgaaagtctgtcaccgagaggactagtttagctaacagtctcatcttgcctcccagggtaaagggagtctgtgtacttggtaacaaatgctgaccccagccagagcaaggataattaggccaaccagctggcacgcatacaggtgtcccttttctggagacagggaggggtggtgatggccactcccattttccagagggggtgtcactgtcccagggccaccctgtcaactagtggcagaggtctcctgttcctaggcttttctcctaatgggggaccctgtgtccattccaacctctgaacccacccacagcctcccagaggccacctcagctcttgaaagaaatacctgaccatcagcactgtctggaaggttaatgcctgggcctccctggctctgccatgccttccctgggtggcccatggcgggtcacttcccactctaagcctcagcttctcttcttggtaacatggggagtgaaactggatgaactctgaggtcccgttccccttgacattcatcagctctgtgaacaccttccccaccctctgactattaaggctgaagcctcattaaggccaattaaaggaagatcaggccttctgagcaccaaatggctgcagtgggttggggtcaagaagcccaggctaatcatgcccagagcgctctgaccaggaggctcagcctagcccagtggcatgaaggcactaccctgagtctcctacctcccccagacggacatcagcttcctggtcatggctcaggaatactgcaaagacaaggggctggcagagcttggggaaaggccatgaggtgaccaaggctgttccctgtggatgaggcaagagggcaagatcctttcccgctggccgcaaggagcttcagaatcctcagagcttccaggcttgcaggcgcaggatccagccaaccagaccatcccatgtgggcagcaaacggcaccagctgagaattttcaaacaggaaaatctcaaaactatagattcaaaagcctttaaaacctcagcttctccagggtccaagagcgacagacattggggccatcaagcatcctaatgccccagaaagcctggcttggaaaggacttgcccaaggtcacaaagcacaccagggcagggctgaggcttctaggccacctggtgcccacatgctctctgctgcgttccagtgagcccctgcttgaacttctcccaggacagggagctcaccacttccaccccagactactcacagagagaagctctcaggacaggagtgaggagtgaaggtggaggaggcgaggggagagatctggcatctaccgatgccagctccatgccagacacagagtgttttacacaccacactttttcccatttaaatctcactgactttatgaggcaggtgttagctgttagcactaccatgacactgaggaggaaggaacagaaggtcagagaggccaagcaactatctccaagcagccactaaagataacaccagagctggggctcatgcctgggtcccagtgatacggaagcctgtcttcccaccaccccacatggcatttaacctggcaaggtactcgagcccaggggtcattcagacccttaaaggggactaggacagcccaaccaggccagggcctgccaggctggggccaacgtgggccagggcacagggtgggaccccatcttcctccccagctgctctcaaggcagagggtagctcagtgcttttggatgctcctgtctatcactgcgtcaagacaaggcctgatccccattttacaagtgaagaaactgaggccgagggtcctgcagcatgcaagtggctaagtgggaccagcactctctgctggcccaggggccaggaccctcagctgcagggagaccctctccagccagggagacccaatccaggtccagccacacctaagacccttggtgtaaccttatgaaggccccagccgactctgagcctcagtttccccagctgtgatatgaacatgacggcaggccctggctcttggggttgtgggaaggaggccagcccagtggctgagcagctgcctgtcccactggagtgcccagacgggcaggcactctctccttagagctccttcctcgaagggctgctcccggctctcctcgaaactcttaattaagggaagggagcctttggagcgcacaggagttaacacctgggattactttatcagatggttccccacccactctctgacctgtggtgggagcctgggccagctgtgcgccccacaaggtgtcaactgggccacctgtggcctctggcagtgtggggagctgtcctggcactgcccagctaaaggatgcaatgagtggccttcctcctggtccccaggccacagagctcaccctgttcttgtgagtccccgtcccagccctcctccagagagcccagtatttagctgccaaggagcctcatgaaaacgcttttactgccaggcacggtggctcatgcctgtaatcccagcactttgggaggcagaggcgggtggatcacaaggtcaggagttcgagacccacctgaccaatacggtgaaaccccgtttctattaaaaatacaaaaattagctgggcgtggtggcgcacacctgtaattccagctactcaggaggctgaggcaggagaatcgcttgaaccctggaggcggaggttgcggtgagcagagatcgtgccactgcactccagcctgggcgacagagcaagactttgtctcaagaagaaaaaaaaaaaaagaaaatgcttttactgtcctgagtcaacaggatccagcagtgaggctctggtgctcccatgcaggggtagggctcagaaggaacagtgccactgcttctccagggaatgggagggtgctcagggcctgcagactgggggtctcggcccagtccctccagatatcagttctgtgacctcaggccagttatttgccatctccgagccccaccaagcctcagtttcctcatctgcacaatggagacaacacctactttccagagttgtggggaggattacacagcatggtaaagtgcccgctcagcacctggcgcggggctggcatttagtaagcacctcattaagctgcttctattctctcagagccaagctgtgggccaggacttcagtgtgtgaaggcgggggcctgacagaaaaaatgtggggtgaatcaggcttcgtgaaacctgggttcgactttatttctctgggtctgttcccaagccctggcctggcatgcagagatcagtgttctggccctggccaccggcgcctcacctgccctcagtttcctcaactgtgaaataaggaaggtgtgatctgtccctgccctggggcctcaccctggggctggtgagggatcctgctaaggcccccctgctgtgtcctgttgaggggggctcagcatctgctggaggagcaaccagctagaacatctacatccagctctggctgaggaagccccaacccagcccagcctcacgccttctcaggctgcagccaagtgaggccggggctcgcccctcccaggcgtgatcttacaagcccgtcctctggtatgtagttggaaccccacagcaggttttttcccagataaatcatggctcctggggctaggggaggggcaggcagttgaccttccatcttggagtaggagcccactagggctggagggaggctggagggcacaagctgctgagagtgagacctgggacccacccgcctcttgtcccaggggagtctaggatcacagggcagcaaggtgtcagggctgaaggggcccctaacagtcttcaatacctgttcccattttacagatgggatgaccggggcttggagaggagctggggcttgttccaggtcccacagtcaggcagaggcagagcacggactcttggctcctggtcctgctgtccactagttccattctagtcatttgggaacaggggggactgacagcagtcctgacaggaacacagccgctcccctaagtgctgcgtcacttccctgccccagggtctgcctgttgtgctgacgacaggtaaggtgagtgaggaggcggaaggctgggctgtcctgactcagccccagcagccccagcctaaagcccccggtgggaaggggccagtgtgcggcaaggcggcccaggcagagggatccccatcctaggcagggggcaggcagagttctccctacacaataccagagtgagaaggggaggtggaagcatgggcacgagaggtgattcatggggagagataaggcagggagcgctcccaggaagcaggcagacaaagcgccccgtcagcatccgtcagtgtccgggccctgcccctgtgagcctgggaagcagctggggcaggacagctggaggactgcagtggcctggatgagctgcccctcccagcccctgcctgtcactctgtcctgccagggccagggcacaagggatagcctagagtttgagggaaacacaggcctggtccccacccctctacccgagaactagctaggtgaccttgggcagcgactaaccagtttctacatctgaaaaatgagacagataacactagctgagattataaagcgcctcgcactcagtcaacacttgctattgttattatccctgcccacacatgccacacaagcctgggccacaggtcccaggacagatgtggcagggaaggaagtgcccagggcagaaagcaggggcttggctcaccacaatgctgtggagtcatgaacaaatccctgtccttctctgtgcctcagtatccttgtctgtcagatgaggagcttagtctctactgcctctgaggcccccactgtgggacccttgaggactccctgaggtctgagagtagggagcagtttcagcagtgagtgccccatcctgagggctggaaaagcagaaagcagggcccacctgtccgaggctggaggacatcactcactatggggccatgtagacagactggcacccaaactggagaccagcttcttcctggctatgtcaccttagacaggtgacagcaatcaccttgtgggaagcaaaggaaggcaatgtcaccttaggtgacactaataaccttgtgggacttttgtgggaagcaaaggaagctccaggtggctcatgggactgtacggagtggctgggtcacagctgtagccagagactcagggaggaacctggggtcagcaggtgaagtcctggccctgggagcccctatctggcccatcgctgggcgggggatctgtctgtctgcagaccctctggctgttcccatctgcctccttcctgtcgctgacaaggaggggaggcacagaggagtgggaaccttggcacagcaggtccccctacccatggcctcagtttccctattttcaagatggaagtggaggctgggtaatgggatcccagcaggctctctgtggggactgggttctctagcctccagccagtcatccccatcaggcacagacatcagcagcacttcctccacaccacagcaggtgtggggcgggtctctcagtctgcaaactatgaaggtcccttcctcctccccctcctcctcctcttcctctaactccttccttacttttgtcacccgatattccatcttcacaatagccaaagatgcagcttttatccacaccacctccatcttatagatcagaaacccgaagcctcaaagctgcccagggtcagtcagtgaattgagagcagccaggccaggggccaggcgcccccacccagctagctgacccaactggtccccttgttgggcagggactccaccttcctggaaactggggccagggccaggggccacctcaccagttcttgacccacgtctggtttctctgcccacgaacttccccaaggccctgtcagttagccaggatggtccccgaagccagcattctggtcttctgcaattggctgccctgctctgggactggaagtataaagggattagacccagctaggaacacctcatcccacaacctgaggcccagacctggcttcagaatccttctcaacacagctcactaggtaagctttatctatcaaattaagatgtgcttggaaacgatgagaaggtacttacgtgcagcaggcattagcacctgctcatggtcacaactgtccagcagtggcctagctgtctctgcaaatggcaagcaccccttctcagaatgtgtgacggtgtgtcagccaagaatggccccccacagctagggcactgcatagcccaacaggggtggagaaggggagggccagagaaggcttgaggtcccttccggtggcaaaattcaggtggacaatgctcaggtggactcactccacttccacagatgaggaccacacctccctcacccaagcatcctggcctggaaagtttccaccattgcaaagctcacaaagaggctcagagagggtgtgcaatctgctcccagttgctcagcacagctaggaaacaggcagtgttgaacaaggacctccaggccagtctcagatggacttggaccatgcctattccctcaccccacaacaaaagctctccccaccagagagctcatggtgtgtgcgcgcctttacagtgaatcagagccactctaagggagagtgagaggaagccctggggttcctcccctccccactccaccctatctcggtgccttcttctggggaaccagaaacaccctccaacaataaagaggccctttgagacggggcagcccactgtcacctgctaggacctgggaaccctaccctgcaaagaaactgcggatccccacgaaggtggggaggaaacctccacccaagaggcagccagggaaaacagcagagatccctagaagcccatgttgggctcccgttttgggctctgagtgagcctgtattgagaggggtccggtggctggttgggccatggctccaggagtccccgcgctgcctcaccttctgtgcctggctgatcatcttccgcaccacctctttgatgtgggcctgcccgtctatggggggctgcatgtagacgctagcccgggtcacgccgcggtaggcgatggtgtcgggccagcccaggtccagctgcgggatggagcggtccgacttctggggccagtactccagggagggcagcggctcggcctcgatggggaccccatccgccccgctggcttcctcgccgtcgccgaccccattgtcctcgggcccctgagaggggcccgtgccccgagggtcctcagagcccgggtcgtacacctcgatggtctccaggatgcgcttgagctccagctccgagaggaagtctcggatgttctcccgcttgagcacctcgtagaaggcgtcccggccgcgggccaccagggcctccagcgccagccgctgctcctcgctgtagaagaactcaggcttggactcgctggagcgccagttcacatggttgtcgtccagacactgcacctgagagaaggccatggcgccgcctgcccgggcactgctgccgggggtgggtgggcaaggtccagctcctagctccggcccagctggggcaccgcgcgctcgggggcctctccgcggcctctgcttctctgcccatgagcaatctgcgggaaagacctgatgagcccggctcggcggggagggcgggccgcgcggggaggggcggcgggggcggggccgggaactcaggtgggcgtgggaaggacggggctggggctggggctgggaagatgaggtgggggcactggactgggatgggaagaaagtaagggatcggaacagcggtgagggagcggtgggccacgtcccagggctcagcgtgcctctacgtgcagggaacccatatcccagatttccggagctgcctgaagtcctcgcaacttctgagggaaactagggcagccggggaacttcccagtagcttcttagagtgggaggcggccccggcacagaggcgccccgcaaaccgagggcttccgggtaagggaggggtcttaaaatttccgggtgccggcaacccaggaggcctgcccggaggaggctggggctctgggaggggtccaggagacccagaaacgcggttgcggggcggcgacgccccgcgagacccgggatccggggggcgcggccgggacttgcttaccgagcgggcgctggcggagcggggcgcacacgcggcggctgcggcggcggcgcgaggctgggcgggggcgcgccggtgactcagggccgccccgcttaccccgccgccgccacctgcggtcacgtgccgcccggggcggggccggaagctgattcacccctcgacagacagacagacctggggcggacgcactgcccacggtcccctggtgcccgaattccgaaaatatcagaggcctaagcccaagagctcctggaacacccatcccagagagggacagtgttctccctgaggtcacacagcgggtcaacagccttggcacccccctgtgcccccagggtctgttggtgatcctggatcaaccctggctgtgcccagtttcgccggcgtggcgggaagtccgtgcggctgtatagatacccagctgtccagttgtggaaacaggtctagggtactgggctgggagcccccaggcagggatagggcactgactgacccaaactcagggctttcctgagcagatacccagttctcagtcctaagccctgatcccctctgggaggggtccccggactgcttctgcgtggcgggcagcacccgacctgaaccctagggcagggaggggccaagagggccgctgtgggctggggtcaggcccagctctctgctgagcgtcccctggggttgggaccctggttatggggagcgtggagaccacatctgaaggcaggctttgagggtgggacagcaaagcccattaaatctggcccaacaaacagcccccaccccatcgcgtgccgcagccagtctgcccggcaccaggcccagcccttcctcccatcccccatacttgctctggatctggatggggctggtttgggtcccgtaaggatgctgcttccgtaggctggtgacatctctaggccttgtgccctcaaaccccccccctccaaggccttctccaccattcatggcccatcaggactccttgcctctgagtccactgccctgggcaatgactagcctcctaggcccagcatccttgtggtccccatcactgacccctcaagcatgaagtcctacactctgccatatagccccccaagggctttatgctactgaacatagtggcccctggggaacaggcacacatatttgcatcctcctcctgccccagggccagagaggggaggtgatcccagcgggggagccctgccttgagggtcctgaagacccatttatagcccctctgctactgtggatcccctgtaagaccttctctgagccgcctcagcttctccctgtgttcttaccaatgcacagaggctggagagttcaggaagggagtccaaggcctcactcccacctccaccaccccaacacttctgcagttgatgagcaggaaggttgtatgcacccagttttccccagtagcgacgttttgcataactataatacaataatatcacagccagaaaattgacactggtgcaatccacaaagcttatttagatttcaccagttttttgtttgttttgggacagggtcttgctctgtcacctaggctggagtgcagtggtatgtacaatcattgctcaatgcagccttgaactcctgggctcaagcctcagcctcctgagtagctgggaccagagacaccatgcccagctaattttttttcttttttcttttttcttttttttttttttttgtagagacaaggcctcactatgttgctcagactggtctcaaactcctggcctcaagtgattctcccaccttggcctcccgaagttctgggattataggcgtgagccactgcactggccagatttcaccagttttacatgcactcatttatgtgtgttatacaaccttattatgtgtatagatttgtgtaaccaccattacagtcaagatacagaactgttctgtcactacaaagatctccttctctgtagccatccccacacctcccccgaccaccattcctaacttctggcaaccactaatctattctacaattcaacaattttgctgtttcaagaatgctatataaatggaagatatagtatataaacttttgggattggccttttttcccacttagcataattctccagcaagtcatccaggttgtttcatggatcaatggtttgtgcttttcattgctgactagtattccatggtatggatataccacagtttgcttaaccatttcagtgattgaaggatatgtggggtttccagcttttgattattacaaataaccttgttatgagcattcatacacatatgtatataaacatcaggtttcatttctctggcataagtgcccaagagtgttattcctgggtcctggtagttgcatgttcaaacactgccaaactttttccagagtggctgtaccatttcacattctcaccaacaatgtatgagtgatccagtttctccacatccttgccaacatgtggtgttaccgctatttttttttttttttttggccattctgataggtagatcatatcttattgtggcttaaatttgtgctttcctgatggctaatgtcattgaatctcttttcatgggcttatatgccatctgtttgtcttttcctttgaaacatttgttcatgtcttttgcccattttctaaatggattgtctattttttaactcttgagttttaacttttttacttttttgttttattagagataggctcttgctctgttatccaggctgaagtgcagtggcttaatgatagctcactgcaacctcaaattcctggactcaagccgtcctcccacttcagcctcctgagtagctgggactacagatgtgcaccaccatgcctggctaattgttttttatttttagtagaatcatggtcttgctatgttgcccaggcttatactgttgaatttcaaaagttctttatatattctagctacaggacctttgttgggtgtgtgctctgcaaatattttctcccagtcagtagcttgctttttcatcctcttcgaggtgtcttacacagagctaaagttttaaatgttgatgaggtccagtttatcaatttttccttttatgcatcatgcttttggcatcaagtctaagaactattcactttgttgaagtcaaaatgaaaatgtagagatgaatctctatatttaacgttttatttgggaagaaaaattgcaattcagggcatgcacaaagactgggtggtctttgatgtgtctggagaacacaaagaaggttagaggttttcttgaaagcagaaatgttacttagtgctctttgagaaagttccttggcactggtaagggtttggggagctgaagagttctgactggtaagtgatggtggtaagcaaaattagtcctagatctgtagcaagttatctcagcagctatagataaaactggttgcaggttgtaaaagggagtttctttcaccagccaggctcatagggaattgcatttttggaataatgttatgtaccctgggtgctttcccccactgtcctcttaactctattttagttttgtagacaagaatgatccaatgtgtatgatcaacttttacagcctagccttaggtcctaaagattttctcctattattttccccaaaagtttgatagttttttttaacattttacatttaaatctgtgatctattttgagttaatttttgtataaggtgtgaagtttagattgagggtaggtttttggcctatagatgttctcagaattctgagtttttacagaggaggagacagcctcacagattttttttttttttttgatacggggtcttgcactgttgcccaggctggcgtgcagtgtcacgatctcagctcactgcaagctccgcctcctgggttcacaccattctcctgcctcagcctccggagtagctgggactacaggcgcctgccaccacgccctgctaattttttgtagttttaatagagacggggtttcaccgtgttagccaggatggtatcgatctcctgacctcgtgatctgcccgcctcagcctcccaaagtgctgggattacaggcgtgagccaccgtgcctggcattattattattattatttttttttttttttttgagatagcgtcttgctgtgtctcccaggctggagtgcaatggcctgatctcggctcactgcaacctccatctcccaggttcagcgattctcgtgccgtagcctcccaagtagctgggactacaggtgcgtgccactgcaccttgctaatatttgtattttttggtagagacagggcttcaccatcttgcccaggctggtctcaaactcctggcctcaagtgattcatccacctcagcctcccaaagtgctaggattacaggcatgagccaccgttcctggccagtctcagagatcttaataatcactcaagatcttacagcaagggattgggagagctgagtttgttttgttgttgttgttgtttgtttgtttgtttgagacagggtcttgctctgtcacctcaaggctggagtgcagcggtgcaatcacggttcactgcagcctgcacctcccatactcaaacaatcctcccacctcagcctcccgaatagctgagactacaggcacgaaccaccacgctaattttaatgtttttggtagagacatgctttcgccaggctttgttgtttaattgagatggggtctccctatattggtcaggttggtcttgaactcctggcctcaaacaatcctcctgcctcggcctcccaaagtgttgggattacagatgtaagccactctgcctgactgagaactggatttgtactcaggtctgggagcctttctcctgctccctcctgcaatggcagtgtctggactggctcccgagaatgtgccgggcctggttagggagtagagagcaccttgattactcctcaagggactgtgtccagtgacctccttgggagggaatcattcactcagtcaacagacactggcagaagctaccatatggttgcttgtgctaagcactgttgagacccagacttttccctgaggccccatagtcatagtctgggtgggagacaggacagtcagaggtcatagagttattggtgctgtggaggatatagccccaaagcctgaagggctcagatgtccataatgaattgagaggaatgagtataagttccctgggataaatccagggaagggcagaaggtgggaagggtgttccagggagaaggaacagcaaacacagagacctagaggtgtccaggagagcctggggtgccagaagtctgggtgaaattagtcaaggagagggtggccgagcgaggtggccatagcaaggggtgtgggagggccttaattggagcctgtgataccccggcagcggctggagaggcacggagcgggtttgagcagggaagagcgtgggcggattggtgggtttcgaagttccctttgcttgcttgcagggggagtggattaggaggcacagcaaggaggtagtgcagttcgcctaataatcaaacaggactgggcattggccatggggagggaagacaaggggacgaggaggggcaacccctggcttctggtgtgggccttggctggacggggagctgatgcaaaagtggggcccagtggggagctcctaggcctgcagaagccagtaccctggcaaacccatagacccctgccagctccccagttctcactgcccccagctctgcctccccggggctgcttactctggagtcctgggggactgtgtttcaatggtgacaccactgccacggttctcataaagaagttctttcttgctgctcagcacaaacacttggtcaaaccagtgggactcggggcggtttcccatgccgagagcctggaatgggctgaagaaactcacaaagaatctcctgactcgggctttctgaaacatatatggctgcaacgcctcacctgtccctcccaggagggctgggtcctccgagtgccagtcagcctgcctaggttcagagcccatcagcagtggctcatcacctgtcctctgaatcctggaccccagtgtcctcagagttctgccatggggcccccggctctgtcttggatccgactgtgtcccccaggcaagttatgtcctttctggtcctgaaaaactaatgggggtagaggtggtagggtagggcagctggatcaaacagtgcctgaactcctcatggctctttctgggatcccttctcccactcctcctctcctcctgtgcctttcctccctcctccccaccatgcagtcacttattcattcattcaatcagtgttcccagaaagtctcttctgggcccggccctggaccaggcgatacctgggacttggagatgattcaaacccagtgtctgcccttggggagcctccgtcctggtggggaaggtagactatgtaaacaaacaactgtgattcaatctttggccttaggagcccttgggaggaagctgctactgccttgggggttgggagagtcagggaaggcctcagagcacaagccctttgcaatgggccttgaagcaggaggtaaacaagggtgtgggtgggtgttagacggacagtggtgccctgggaggagggactacgtctgcaaaggcatggaggcgtccaagtgctgggtgtgtgtgagaaaatacaagcaggtcagggtggctcgtgcacggtgctgggatgggaggttctgggaccaactgtcaagggcctcgaatgccatagaaaggatacttttttcccccaggatgccatgggctgagaggtgggggtagggaggagggtcctgagaaataagtaataggctgagagctgtgactccaaagtgtggagaggatggacaggaggctggggaggagcatgggattgggcagggtgggccccagacgggagggggaagaagctatgagcctggggggctaatgggaggagccagggaggtgcctgggggatgacaggaacctggcgtccgggaagcctggagctcaaacaggctgggctggagactgggacatgttcaagggtgccagggtaggggacactgccagggtaggggggactgccagggtaggggacactgccccaggccagctggcctgggggaaggggtgtgagacccgcccttccccatgggctgggcatctaagaagggacgtatcagaagggggctttggagggggcagtctacagagggagcaccaagtcacagaagtgtcaatgccagccgcccctgctgctgctgtgttgcaactctgcctgcccctaaccagccactgcagtgctgtcagtcagcttgtttctgaactcccccgtaatcatcatcttctggttagctctgcactctgggccctcctgaaaaccccagaagcaggggccaaagctttctagaaagtcttttatgggaggaaaaagagaatgtgggtcaactctcttcatccctacgtatcactaggccaaagtcagccccacgactgctaacaccagcaaatctcactgagcagagcagtgaggagagccccacacctcagggctatggaggtaggccggggttctgcccccacacagggcaggaggccgagggatgcctggatttagggttcagtcgggatctggcctgagcctgggaaattcgtgagtcctttcattcaacagatgagccgtgtgtaccaccccagccatgggggagatagcacgaggcaaaccccgtcctctcaggactcacctgccacagggaagtggcaagaaccaaataaacatgtccaagtcctcccagggatgacaagggatgagggaaagcgatgtggggcaaggggacagacggagaatggggtgggaaggacagaccggaattcgggaaggaggcagtcctcaggcgaggcctggggcaggcctcaggtgggagcgaggagggacttgtggggaggggccaagggtctggatcacccagggtcttgtagactgttgagaggctgagtggctggagagtcctgggcatcagctcagctctctgcagcaggaaatagcctggcgtaaagcttggaccccagggttggagacaggggtgtggatgggctctgaccccacgtcctaagccaggaagttggagcaggcaggcctcgccagcccctgagctttcaccacagccctgctgcatgagctgcagctgtgtgacagcacactcaagccggctgcccatggacagacgcgacttgttgacttgtcgctgagtgaacacaaagcccagggaacaggttgagggcctggggcagggcccatcctgcaggcctctctcttctctagcctccatttccccctttggggagaatggctggggacgaggggggcaagggaggctcaggccccaggtagactctaatggcggacctcacacagcagagccaacggcaggtgagccccctggccaagaagtaggatcaggaagaagagttatgatggagaacagcagggaaaaggattttcagaggccatgccctccctgtggctcagattgtgaaactgaggcccaaggccaaatggtaacaggtcagaggcattgatggagcaggtctgggccaggctcctgcccccagccctatcttgcccaccccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtgaggctgtgtgggtgggggtctgggtggagggcgtggggttggacttggggcccaatgagtatggggactgtggaggctgccactcactggccaagaaatttggggcatgtcacttccctgcttggagcctgggtgtcctcatttgtaaattggagataatggcatctacccacccctcagcgttgttgctgggattaaacataatgacacagggaaaatgctgggtgcaggcttggccatgctgtagttcccaccttgggccttcgcttttctcttctgttctgggcaaggggactcgctaagccctccagggctgacaccgagccattgttgggccacagtccctctctaggtcttgagttccctctctaagaaatggatggaataagctccaagttcatccatctccatgagcaagacaagggagtgggtggagaaatgttttggggaaaactgtgatttgactcactttcctttgggctccatcccaaccagcttctgacaagtgaacagagagcccagagacacctggaagtcacacagccaatcagacacagaaccgaggccagacaacccagccaggcaataaatggctgtgccttccgggcaggggggcctatgtcaggcttatcctaggacagacgggcaagagtttgtagaggtaaaggaggtgcttaaaattgcaggagttcttgtagacagacttgaactcatccccagagaggggaggcgaccagcctgaagccacacagcacagagtgggcagttgagcatccttccaccttccttagggctcctcaccctcaggccctcttgagcccacaactcccagaaggcctttcacagcaatgctacccgcacctcctaggggagccctcactcccactctggaaaaccacagagccaaggagagaggggatccactatgcctgctgggtcctgccatgcacaggaagtggcggaaaattccagagactggggcactgcatgctggggtgaggtgtgcatcttgcccagggtgtggccttcaagcagaggccccgcccaagccttcctcaccaaccccaccgcaccccaaagtcctgccgctggcctgctgtgaatccctgggcaatctcttcacttctctgagcttccatttcctcatctgtcaagcgggttaatcatgctttcctcggacgaaggcatgggtgtgaaagtgctttgtcaacgccaggctctgcagaaaggacaggcctgatcgcagcctcagcattatgagtaattatggtcgggcctagggttgccagcaagcctagggctcaagcagccagctccgaagtccccacggtttgtccttggcctccccagtctcctcattctgggtcttgctcacctcaaacctcctcagcttctctccctccccgccctctgccttggaggagcatgcaaatggcgggcgggcctcaggcattagagcccaggcgggaggggttcccggggctgtctcaaggccggacagggtcacacatcccccgtcccaccccaggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggtacgggggtgggggccagtacgggggtgggggaacactacaagggtgggcgcccgcactgactttgagggatgagccggagtttgccacttagagaaaggtggatgccaggaaggagggaagagaagggccagtgtaccccatccataccacctctcacattgctctcctgtccacctctgtgtgatcacagccctcatctgggatgcatctccacccttgagctggattccttctgcaggggccagccctccctccccaaccatgccacagatctctctatctccccgaaaacctgggcccccattcctcctgatggttcccagctgcgccacagagggcccccgggccagcactcaggactggccacacttgggctgccacgtccctcagcctccatggccctggccctactgagctccagcttgtttcctcccagcccagcttgtcccctcctttttcacctcgatgactcatgctgatctttctggactctgcctgtgtcccctcctccgtgcagtcctccctgagaccctcaaccaaggaatgagcctctctccccttcataccccagggacgcttgccagattcttcccacagcacatgtggccattacaggccaagagacctccccgacacccttctccaaatatctgggcgcttcatgaggaccggggctgtgtctggagaacaggtggtgtttggttacatgaataagttctttagtggcgatttctcagattttggtgtatccatcacccgagtggtatacactgtacccaatgtgtagtcttttatccctcacaccctcccagcgtttcccctgagtcctcaaagtccattgtatcattcttttttttttttttgagacagtctcgttttgtcacccaggctggagtgcagtggtatgatcttggctccctgcgacctccacctcccgggttcaagagattctcgtgtctcagcctcttgagtagctgggattgcaggagcgcaccaccacgcctggctactttttgtatttttagtagagacagggtctcaccatgttggccaggctggtctcgaactcctgacctcaggttattcatccacctcagcgggctgggattacaggtatgagccagtgtgcccagcccatcctatcactcttatgcctttacatcctcagaggttagctcccatgtgcacgtgtctatttgcgccctccctggccctccagtcccaccctcttgttgtcctctgagcagtgtggctcacactctgctgctcgggggtccagccttctggcacaacagagcaccccctggccaggagcccagggcacccatcctgggggtggggtctcctccagagctccaggcagctgtcccagggatgcaaaatagtcaggcttctgttggaagggccctgttgggacacgccagaggcgggtgcgagtgagctcatccacgggctcacaggattctccaaaacaaggagcctcccacctctcactgggcaggacacttccatgtccctgtgtcctgggcacttggccccttgaccacttctccccctctggctcccctgcctctcctcagaagctgtgtggcctggggaagaccctgcccctctctgaccatgtgtctcctctgaggccagaccttgctctaagcccctccatgctccagcatcctgggccctgggaactggatgccctcctgccacccagtgtgtgacactggtagcccctgtacctgcccagtggccctcatgtcccctgcccactacttcctggcctcctcacccagactcccacctgcaaccaaaagtcttgacctggcctcctgctgcgccagctcacccagctgcccgtgcccttgaccctccttcccacctcttctgccaagtcaacccccgcccctagccctgcaagcctggcagtcggcctccctgaggagcaaggcacaaggctgcgtggtgcagggcaggttgctcaccctctctgggccccagttctctcagctgccagctggatagagcagaaagggccccgtgccaggtgtcaggctggccagctcaacttcccgtccctcttacagcactgggataccctcaacacccccagcccctcaaagccgtctcagcttcctcctgcccgaaacaccaccattggagcggtatctcctaggcctcgtggtcatggatctctggtagggtgaatggcctgacaacagtctctgtcagggagaggcgaggcttacagagagaagaccaacagcccagaggcctggagaggaggccatcgcagggccgggtgcagtaccatgccggtgaccctgatggctctgtccagctgagcagaggctggaggagccgtcacaggctgggggagagcgatgacccgcccccactcccgtatgcctgccccaagcccccacacctcagtccactgttccgccactgcccccctgccccactctcccctgtctgtgttcccggctgttcagtccgtaaatggggcccacagcctcctggaaaccctgtgcaggactcggagagatctcagacacccctccttgagatgttccacagtaactgtggctgcagcccagggagatgctggagggcactatccaccctgatggtggcatgggagggagtggcattccaggcagaaggagcagcctctgggtttgggggtcctctggcagccaggtaagaaggctgggtaagaaagcgagggcctggctggagtggccccagccctggcacagagatgcagagtctggtgttgggcgggagagctgtgtgcagagggcggggtgggcaggcgttaatggaggcccgcctgggcctttgatgagggcagcgcccgcctgcctgcctggctaggggttaattagccttaatcaaggtggcacctccttcctccaccctctccctcaggcctagaagggaagaaagggagggaggaaggcggacaggcgctgagaggacccaccctagctgaacacatagcctctgtcacccctgccaccacagccagggttccagcgggtcacccaccacccaccttgggggtgaggaatgccaactgacccaggacacaggggtgaggtgctcagccagggaggagcggatggatgccatgccccagcttcatccccttagctgggtcccatgcccctcaaggctcggggagggggtgcctcctcctgaaagccctcctagattgatgtttcctctgagctgctccagcccagtccgagtgtaggtaagaggctcatctgttttctttgctggactctgagtgctgggcaggcaccaggtcccactcatcgccgagttggggatcctagggtagtgtcctacgcaggtgagcacctcaccagtggtttgttggatgaacaagtgtagcatgtgcctgttgtagaggggctcttggcctaagggagaggcaggcaggagctgacacgcaggggacaggaggggacgggctcatgctggcccagcagggctccggcttcacagctggggagtatgggctctaaccccaacccacacctctggctccaaactttgcatccttagtaagcaggttgccctgtgaaggatgtgcagcacagggctgtcggggtggggatgtgccagccagaggtcccagctcccacaaatgccggccagtgtgaaaaatcctagtgtcttcaaataaccaccaggaagtcagtctggcccagatcggggggcagtggtcattcatgcactcaccaaatgcttagtaagcacctactatatgctgggagacacagcaatgaactaaagagatgaggctcctgctctcctggtgcttccattgggaggggaagacaggcagtaaacaagtagacacccaggtaaatgtgcatgtagtgactgggacaggtgctttgaaggagagacaagagggagctccatggcggagctccaagggctggctccgcagagaccccagggcagggaaggagcagacagcacttagagtcaggagctgcacctgcaggatccagggagccaccaaagggtttggagcagggcaggactggccaggtcactggtggtgtggaccagagtccagggaggaggctggagctggggtagcaggggaaagattagagagcaagtcttagtgaccaggggaggtgggagagagctgaagagcctcccacgacgaccgctgcctgccttccactcgcctgcaggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcaggtgggcgtcggcggtctgctctccctggggacgtgccacaatttgctcttccctgctgcctgtggggggagccttggtcctcctcccgtagccccacatgccctgcctccctcctccccagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccaggtgagccagccctgacccctgaccctgacccctaacaatttcttactctggtcccattctcatccccgacccactctgactcagaattttctagccctggactacctagccccgtccctttttgaactcagctgccatcttgccatccccaacctttgatcctgtctgggtcacccccaccctgccatcccccacccccaaccctatcctcactcatttcttacagattgagaaccttacctggtggaccctggctcaggatgtgcccttgggaactaaagcaggtaagtggatgaccctaggcactcctccaccttgaccctggcctggaggcaagggcaccaggtgtaaccttgtgtccttcatctgtccctctccttctgcaaccccctccaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccc

SEQ ID NO: 257 - DNA, 133386 bp, Homo sapiens
agaaaggcgataaacatttaaaagaaaatatccccattttgtgttaagattaaagaggctataaaatgagccctgctgggactgtaactgcctaaagggttctctttgcctgctgcccagacagagccgatttatcaagacgggggaattgcaatagagaaagagtttaattcatacagagccagctaaactagagaccagagttttaccactcaaatcagtctccctgaaaatccagagactgggtttttttgtttgtttgtttgtttgtttgtttgtttttgagacggagtcttgatctgtcaccccggctggagtgcagtggctcgttcttggctcactgcaagctccgcctctcgggttcacgccattctcctgcctcagcctcccaagcagctgggactacaggcgtccgccaccacgcccggctaatttttctgtatttctagtagagacggggtttcaccatgttagccaggatggtctcgatctcctgaccttgtgatccgcccgcctcggcctcccaaagtgctgggattacaggcctgagccaccacccccggccggagactggggttttttttaaggataatttggtgtgtagggcaccagggaatgtggagtgctgattggtcaggttggaggatgaagtcacaggaagttcaagcagtttgtttttgcggtcttctgtttctgggtgggatcacagaaccggttgaggcagattatctgtctgagtggcaccagctggtgcatcagaatgcagggtctgaaaaatgtcttgagcacaaataacagattttacaacagtgatgttatccctaggagtaatggggaggtagagaatcttgtggcctctggctgcatgactcctaaaccataattttgaatcttgtgcctaacttgttagtcttacaaaggcattctggtacccaggcaagaagtgggtttgttttgggaaagggctgttattgtctttgtttcaaagttaaactataaactaagtttctcccaaagttagttcaggctatgatcaggaatgaacaggggcagcttagagtttagaagcaagatggaatcagttaggtgagatctcacactgtcataattttctcactgttataatttttgcaaaggtggtttcagggtaatcatttttttgatggcagagctctttgaacaggcaggtgtggtttgatcagtccctgcggactgcttcacagtggactacttcacatgcagagaccacatagtggcaaagtcacaactagaaattaaacaagtcttttttttttcttttttgagatggagtctcactctgttggccaggctagagtgcagtggcgcgatcttggctcactgcatcctctgtctccggggttcaagtggttctcctgcctctgcttccgagtatctgggattacaagtacatgccaccacgcccggataatttttgtatttttagtagagacagcgttttaccatgttggccaggctggtcttgaactcctgacctcaggtaatttgcctgcctcagtctcccaaagtgctgggattacaagtgtgagccactccacccagcctaaacacgtcttaataaaaaatattccctacaatatggtgactttaattccttaaataggaaaggttagaggcagactagattcaaaaacttaagtatagagaggctgtaaacagtaaagtcttaaaaataggattaggccccagagtgtaatggagagagctccgggctaagatcaggcacgctgggccacagggcttctcaaactggttgtgaaggttggcctgcctcacaggctctccaacaaccactcactgtcctgtaaagttgaggggtttggtagaacagtgatttccagactcctcctcctcctcctcctcctcctcctccttcttcctcctcctccctcctcctccctcctcctgcctcttcctcctcctacctcctcttccttttccctgttcctccttcctcttcctcctccttcctcctcctccctcttcttcctcctccctcttcctcctcctccctcctccttcctcttcctcctcctccctcttcctcctccttcatcctcctccctcttcctcctcctccctcttcctcctcctcctcgttccttctccttctccctgcttctccttccccttctcccttcttctccttctcctcccttctcccttcttcttctttcttcttactgtctcagctcatggtcagaagtcaagtgacctggatttctgcctggccagcactgtgattaagatccacataagtttctgggcactacagccctgcaggacccagggagcaccagacacactggagcaaaggcagttggtaggcccttgggctgtgcaaaacggtggctctgagcctggcatgttttttaatccttaggtttttccctctaaaaagggggcaatgatgtcatccttatcagcctcccaagctgatttcaaggctccaaagctaggatggaaggaaaggtgctttggccccaagagccccacactgcgatattctcacagtctaacttatttctttctccctagacatctctttcgtgagaagaaagagaggagggaagatgctctgtgatgctgccagtaatgctgaccagtcgtggtgctgtcacctccttggctgtctttgcaatctgttcccaactgaggtttccattgcagtgtaactgaccactccaggggccactgagggctgtcaggatgagctatccctccaccccaggctgtcactgccaggtaaacatgcatccctgcaaatgcaagtgctgtgtaagaaaaatgattggtggccgggtgtggtggctgatgcctgtaatcccagaactttgggaggctgaggcaggaggatggcttgagcccaggagtttgagaccagcctaggcaacatggtgagaccccatctctgtaagaaataaacaacaacgacaacaaaaattagctgtcatggtcgtgagtgcctgtagtcccagctactcaggaggctgaggtgggaggatcacttgagcccaggaagtcaaggctgcagtgagctatgactgcaccactgcactccagtttgggcaacagagcaagacactgtttcaaaacaaaacaaaacaaaagataatgaggccgggcgcggtagctcatgcctgtaatcccagcactttgggaggcctaggcgggtggatcacgaggtcaggagttcatgaccagtctggccaagatggtgaaaccccgtctctactaaaaatacaaaaattagctgggtctggtggcaggtgcctgtattctcatctactcgggaggctgaggcaggagaatcgcttgaactcgggtgggagaggttgcagtgagacgagatcgcgacactgcagtccagcctgggcgatagaatgagactccatgtcaaaaaataataataataaaaatgaaaaatgtttggcatgtctgggcagagagcctctggtcctagaattgagttgacccagagagaagttaccctactgattcaccctgcagtgcaagtgcctacctcgtctgcatggctttctgagatctcaactgtgtggtcttctctctgctgttggggaaggctcactgagccaacactaaattattctgagctagactgttttgtcagctagcagcaattacccttctactctcctcacacttcccaacctcaaatatccccgtcagtcatccaccgacagagttgaagaatccacaaaatgaccaaggagctgggggaggaaagggctagggtgacgagcacgtagggccggctgttgtcaaggcatttctcgccatctgctatttcacttcagagaccgaaactcagttggttgggtaagactgggaatgtgatttttagcaatgtgtttgtttaaatagaaccccgctataaaaacaatttggaggattatgattcgtttttgaatgagaactagttttaatggaattttttatgtgcattccaatcatgactaaaatccgcatcatgatcaaagtctgcctgagtactgtatgtgcttcatgagttgtgctctaaccattagaaacccatgtttattcagtgtgatgccctgcactgaaagtggtggttttctctcgtggggaagcagagtgtattcttagaactgttataatgggctttatttcttgaaacagtttgataagtatttattaaatgcctactgtgtgcaagtgttggagattcagatgcaaaaaggataaggtcctggtttcaaggagtttgctgtttagtgggtgtattaggctgctctgactgccataacaaaatactatggactgggtgacttacacaacagaaatttattttctgacagttctggaggccagaagtccaagatcgaggcaccgtcagggctggtctggtgagggctttcctcctggtttgcagaaggctgccttctccctctgtccgtacatggcttttcctctgtgccctcacagagagagatctcttatgtctcttccccttcttacaaggacaccacttctattggattagggccccactcttaggaccttatttagccataattacctccctacaaggccctatcaccgaatagagtcacattgaggattaggacttcaacatatgaattttggaaaggaacacaattccgtccacaacagtcaataagatagaattttaactctgaggccaggcacagtggctctcacctgtaatcccagcactttgggaggccgaagcagggggattgcttgaggtcaggagtttgagaccagcctggcaacactacaaaaaattaaaaacaaaattagccaggtgtgatggtgcatgcctgttgtcctagctgttcaggaggctgagaggggaggattgcttgggcctaggcatttgaagctgcagtgagctatgattgcaccattgtactctagcctggtcaacagagtgagactatctctaaactttttttttaattaaaaaattttaactctgctctgttacaaggagaaatgtcttgggtatgaacatagcaagatcccatctctacaaaaataaaaataaaacacaagccaggtgtggtagcatgcacctgtagtcccagtgatttgggagactgaggcaggagtgtcacctgagcccaggagttcaacctgcaattagttacgaccacacagctgcactctagcctgggcaacagagcaagaccctatctctaaaaaaaaaaaaaaaattaatgaaagaagatgcaatttgaaacacctttctcagatgaattttgtgaatttatttggaaacttttggggaaaagaagaaaagttgaatacagaaatagaaactggtattgtgaaaggaaagggtaggacaggccgcttgggagaatgggtcagtagtaaaaatagagcatgccttgaatctaggatgagcaagcagggtgacagagaaggggaggtgacctggggtaactgagagctctctccacacagcaagaagttgcagctgaaggatgtggtccatgagagatcccagggcatggaccagaggcagaaagaggatcttgtcagtaacctcaaaaactcggattaggtcctgaatttacatctctggtctttggtttaggtttgtaattaaaagatgaaagcacttggcttccttgcataagcgactttggttttgccatggctgtctacctgtgttggccaacatggcagccccgagtcacatgaggctcctgagcatagggaaccaggctcatctgaagcgagatgcactgcaagagtgaagtacccgctgcatctgggggacttaatgcatgcaaaagaacatgaaatacctcatccatatttttggtattgatgacgtgttgaaataatattttaaacacattaggctaaataaagtatgttattaaaatggattttgctggtttctttttactttctttaacatggctattagaacttcacttgcacaggtggcccacgttgtgtttctgttggacggcgctggtccaggcccttgtcacccctaccttttgtgtactttgaattttcttccctctctcctctctctccaacaccagcagcagcaggagcaacaaaacaccagtctctgaagtgcgtgccggccactgtatcgcctcccaccctccttgctgtggttggttcggacccctgggctgctgtcccaaattccttgacgatttcagcacctggattacagccacgttttccaacaatattcctggtctccaacactatttctcagcgatttcagcatctgtggataattcttccagccctgtggctccaggttctgctctcagctcaaatgatcttatcctccactctccctcagcccttcttttccacagtcacactctgcacttaatactgataaccccaaaactacactgccccaggctcagttttaagcgtcacgttctccagcccccacctcctccttccccttcagtgcctttagtacggggacttcaatgattccctgacaccgctgggacctccgatatgtagctcctatttcctgctcacatctgttacctccctcatgccctcatttttctcctaaccccactgggctccagagtccatcatcgtagcccttcccttctatgtgctttgcttcctttgacccccactctgtgtcgtacccgcctggtaaaccccagccctggttaaatccacctctcctctttctccatgtcggcacctggacagctgaactaagccgtagagaagcacaggtgaggctgagtagtctctcccaggttcccgagcactaagctgggcgggctgtaggttagcctggctggagatcctgcactttgtgtatgtccctagccctctctttccctcatgtatttcacatcgtgccctctctccttaaaccctgaacatctcctcactcttagctgatgaccttgctccttactttactgtaaaagagatactgcactttcagaagacagcttctcgccttgggcactcccacaaccacatctacccacctcaccggatctgcagccacacaccctgccttccccttcaccaggtataaattatgctgtggcaaggctgtgactcctcccagctctagacccctacttcctgactcctcagttatttgctttctatccatgtataattcttatccatgtatcacttctcaaccccacagcccccaagagggttgtctacactcactgtcttcacctgttctcctcccattctgtctaaaccacttgcatcaggcattcattttgtccagtctactgaaaatactcctaccaaggtcagcaatggctccactcccatggtcaatatcaagttccgggtctcagcccacttgaacttgcagtagaatttagcccagttgattccactttcttccccttgaactcgttcttacttggcctcctgggagcccttcttccccagttgtcctcctgcctctctgtcaggtcatcctcagtttcctctccttcttcctcctcatctccccagcctctaactttgaaatgcctcaaggcccagtccttgaatgtcttctcctttttaatggcccgtatttcacagatactctcatcttgcctcacagataccctcgtcttgcctcacggcctcaaattccacctgtttgcatacaacacccacatttatatacccaagctacaactttcctccggctcctgacactcccctggacatggcctggctgcctcacaggcttctcgaactccacaggccctgctaacccgcttcacctgcacctgtccattcagcaaatggctaaacacgtattctctctttctaccacaacacgtatctcttccgtcagtgaatcaaatcgaagacctcccaccagatagtactacctctgccacaacctgatttatgctaacatcctccctgtgtctaggccagtgccttcacctcccacctgacctcctccttcctgccatggcccctagagtgtcacctgaacacaggggccataccgaggctgttcacgcctcagtcccccaagttaaccacattcctcctctcagaacctcctgtggtttattatctcactgggggtaaaagcaccagcccacaaagcccgtttggacctggtcgccaaagacccctgccttcagcacctgactgttctccttgccgggccgttcctgccttgctggcctttctgcggttcttcactcctggctgcctcctgcttctggaacttcgaacttgctgtttcttttgcctggaatacttttcccccaagaacctgctggcctcggtcgcctatttccttcatgtctttgcccaagtgtgacctcatgagtgagacgtttcccatcacactatggacgatggaacccccaggtccctgccactcctttcctttaatgatgctttacttttttccatagaactgttcacgcactgacatcagtttgattgttgttgctgttattgtattttgcttgactgcctccctactgggatacagactccaccaggccggcactttgttttatttactgccatgtcccagtgcctagcacagtgcctggcatgggctaaatgtgtggggggagaatttggggaacatggtggtcttacttgcaaacttctaacaaggcctggtctctacagcagggctttggttaggcatgacagggcatgcgagctctcatcctgtgtgggttcttttccgggtctctgtctactaattatgaagtaaaaggaagctctcctccagtgaaagtaatttcctgcatcccattagaacagctgagggaagtgtcaatgggataggtgtgattgggaccacggaggcagtgtcctcctgggtgcctggatcacatcgctggaaggaaacacctgtttcaccaacccaaaggctacctgctggtccagggtccaggcccggctgtactgagatcacagctcagggccctgcacatgctggggctctgctgacttgattctagaaatgtctaatatcaccagaaccattcaagtgccacgaaataacacatttatgtattattctgcttcaggtgagctcaggaggaaaagacagatatctattcactaaaaatattcttttgattggccggcacggtggcttacacctgtaatcccagcactttgggaggctgaggcaggtggatcacctgaggtcgggagttcaagaccagcctcaccaacatggtgaaaccccgtctctactaaaatacaaaaaattagccaggcattgtggcacgcgcctgtagtcccagctactcaggaagctgaggcaggagaatcgcttgaacctgggaggcggaggttgcagtgagctaacatctcaccactgcactccagcctggtgacagagcaagtctctgtctcaaaaaaaaaaaagttattttgatcaacttcttatggacaaagttcagaaagcaaagaacaatgttttactacatacacatacacatgcatgcacacaaactagaaaaaaaaatttttttgagtgctttgtctggcatctggcgatggtgtttcccgcaccatctggcctgtggtctgtggggacgtacatacgtcttgttagggctctccatccagtccacacatcaatggcttgcctggcttacgtagtctgagcaggtgcccagctttgtcgcagatattgaagccgtgtaaaataaatgccttttgattgttcacactttaagcaatattggtacaatattaaacccattgtcccaggcactccctctccttactgcttatggcacttcatgtattaaaaaatgacagtggcagcattgcccagacatgcgttttgtcatcaagtcttaatgcagtccacctggtccctcaggcaaatgaatggaggcacagaagatgaaatgattttcaaaatgccattaggaaagctcaggccagaactggaaatgggtcccgcacagggcactcggccactcttgcctggccatctcctttttggcactaagccacaagcacacaatgatatagaatgaatggttatcactggggatccagaagggtcattcaatcagttctcagtcttatcaggtctaagttcctttcttatcaggtcctaaaggcctaatcttatcattgtgacaaagataactgtagagtctgttaaacttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaattgaactcttgtactgtatcttctggaaatgacctgtcatttctgtacttgacaaagactctatttctttcagctcttttggcagcatcttaccatgaaccataaaaatgacttttgcaggaagatttacagatgtgtacgggacaaggtaacaaaactatttgttggaacttgaggaggcagcttgatgtagcaggaagaacaagggtcgcttcctgtgtgacctcaggcaagttgttaaacctctcagagcctcattttctcactcataaaatggttgcggcaatagtctatacctccttggtctgctgtgaagatgaaatgagaagatgaggcttgtaaagcacctggcacattgtggatgttcaacaaatatcagtctctcctcactcccttcaatggtagacaagatataaatttttgttttgtaaagcacacacacacacacacacacacacacacacacacagctctatcatgtacagaagttattatgtgtttttacatgttgaatgtaaatttacgaaggtcttctttttgcttgcagcatgaaagcatttcatggcattacacctctattgaaaaacatcgcggatgttatgatctaacaagccatgtgctagtgcatcatttcaggttgtgaagaaatacatttggccaccagtagaggagtttctcatggctccccttccctctgtgggaatactagatgaaatgaaagtctgtgttttgaaatcctttgattgcataaacatttttacgaatggagttgaatttatgacttcctgggggtgactgggaccttcctcccccatgaagaggtgggttatttgtagccagagttctcacctgcagccaagtgcgggtctctgcacctgtctgcctcctctcctcctgaggctttttttttttttttcatcacacctggaaggaggctcagtggcaagggctaatgaaaatgtggtcacatcctggaggactctgatatttttgctcatgacagatccttgcatgacttcctcagaatctttactcagcactccagggggggctctgcctcttgcctgccatgagttgccctccagacactgcacgtcctgggttttagctgtgaagcccgtcgcatagctatgtttatttccttctgtcccttctaggagttccacaaaagggcaatatgtcacatgattctacaggttgtaaaatgttcaagtccatagaaatgagcccgatagtatttattttaaccatttgctctttaaaaggtcagagaggcagtgatgtaattgttctctgttgctgcttgtccttccccatcctcttcctttctcaaaagaaatgatgtggggcagcttcgctgggggagaggagtctgtcccctcgagcaaggaccccactgccagccaagcttggatgcaggaggcttttcagtgggtgacaacatctgattcagaaacaaggcagctttgctttcaggagcccagatggggtgtggagcaatgacatttagaatgatcttgtttttggttgaaaacagagcattttccctgggaaagaacagaatatggagatcagagcaactcccctctgtttcctgtcctctcctgtgtgtgctgtgtgctggcctctggggtagggaaagggggccaacctcgtctcatctctaaggggatcttagtctcaaagaggaccctaaagactatcagatacaaggaatttctacctaaggaaaatatggtgaactaataggaagcccctatttattgtttttctgcagataaagtggggaaatcgaatgtgataatgaatataaaaattattctaaccttttaaaatgatgccttaccaagaggtaggaggtaggattcagagtttggcagggttataaagactaatttctttctgtcttcccccaaacccattcccaaagtgaactgtaaggttaaaactataacaagaagatttaagtaaatttgcaaatatgtagagaatactaaatcatttgtatcctttaggcattcagacaatttgcctaagtcattgtaggttactaggtgccacttccgagaattccttggggatggggaggagattgtttggataatgcctgtcctaactgaacgggaagggtttgtagcattcctactacaaagattcatgcacagccttctctgcagaacaccatgatgtggacaaggcaaagacggggaagcggaagccgctgtctatgtcataggagaaagagacaccgcataactacaacaccaggctgcacacaagtttgtttgacaagtgttaggaacaaaattgtgtggcagaggtcaccacagcaggggctcttcctgccacccccatattgcatgcagcctcttctgttccctcccctgcccactggggtttctcctcagcactcatcatgccatatatcgatttgcttatttgctcgttctctgtctcttcacgctagactataagctccttgagggcagggacgtagctttgctcactgctgtagccccagcttatttgctgtgttggtcgaatccactgcacccctctctgggctgtttcctttgtacatataaatagactcaaattgcttccacctaaccagaagccattccttgccccacagccctttccagtttctatctcccctccctcccttccttccaaaccaccttctggaaaggctcttccacactcactgtcctgactcttgccacaattcacccctcaacatcctgccatttgtcttgcagcctgaccatcatagagagattggtccagataggaaggtgagtaacttccacagtgtcaaatctgatgggctgttttctacctatgccttttgtggcatttaatacccacagtcttcctgaaattatctcttttcttggattctagtttgctacatttttctccagctctctttttgaatcctatcttcctgattggaatcttctcacttctttcctccctcttctactgctcctcccttaaatggacacattttccataattcagtggctgggcctctgctctcctctttctgagaaatctccctggatcctgatccataatcacctgcttattaatgaacctcaaatagacatttgctgaccagaaccctttgctgggctccagtcctgtgtgtccaatcatctaatggactttttgacccaatgtcctgcaggtgcttgtaacccattcatttccccaccgtttcttttttcttttcttttcttttccttttttttttttttttttttttttgagacagagtcttgctctgttgccccagctggagtgcggtggcgtgatttcggctcactgcaacctccacctcccaggttcaagcaattctcctgcctcagcctcccaagtagctgggattacaggagtgagccactgcgccgggcctgcccctattcttttttcagtgaagtacaccgctggtcaccctgtcccccttgctatgctattccctttgcacagactgctctacctttttttaatctagcaaactccatttatccatctacgtccagctcaagcattagagactcaggagagcctctggaagctgagttcctggataaccgtgccataccttttctttcccagactttccacatctttcccttcctcactctcagcaaatgatggctggctcccctttacacaaggggaatagaagcaaccggaagaactcttccagacatccccgctgtcccctctgctgacctagctccatcttcttcatatcagcctctcccctgtgtgctcagggggaactcactatgcccctccctggctaaggtgataccctggctaagatgctccaaccccttcccctgttgcctgcccgatggcatttcgccagcaattctccctctctgtcctgcaccatcaatttcagtccaggataacggaggacagaattttcaggaatcaggatggaggagggttggtgaacagcaccactggccttgactagcctgctccctgccacacatactggttgtttctctggagacagcattgtatgcactgagatgagcaactggagagccaccagcagccatcccctctctttgtgcctcacagctccagtgactgatggagatggagatgggatcgttggctgccttcatggagttgtttaaggagcacttagaagatgctttacgggcatccctagaatttcaccattagaagagtagttctgttaggttgaaatttgtctttttactcaacctcttcttaaattaggaatcacttctggaaaggaaaacacatcaagccatacatactttttcctgtgctttttctcatggagaggagcagcacaagacaagacacccagctgttcaggctgctgaatgagatggtgaggagtgggtggtagaagtgaagaaaggaggaggtgggagcaatcaagtatttgcttgcttgattccacaaacaagaagcttcttttctctttaacctaacatttgactgtttaactttgcaaggttatatgggaaaaaaaatccttgatatgaaaacattagcaaatgtatcacttataaaatgggtaccatcaggcctccccctgcttagcaccagagtctctctcactgcctcatctacagttttgtggatcagtcttgtgatgcctgagagtcaatgtgcaaactgtcctcgaactttaattgatgatcttgacaaacattcaggattctgtgaaggaggtaagagaggtgtcacagaactgctaaaatacacttcaactattgataaaagagcatggagcagagttagaccggttagcagctgaatcagaggtaaataaacaaggatgatgatgagatgggagcttccaaaaagaagcgttttaatatcaaatgttgaagagaggctcttgggaaaactgctgaagtctttagatatttttgcaaaaattacccactttttgatgttcagcaaaagtaaccattaagtaaagacagaaaaattggctgggtacggtggctcatgcctgtaatcccagcactttgggaggctgaggtgagcagatcacctgaggtcaggagtttgagaccagcctggccaacatggtgaaaccccatctctgctgaaaatacaaaaattagctgggtgtggtggtgggcacctgtaatcccagctacttgggaggctgaggcaggagaattgcttgaacctgggaggcggaggttgcagtaagctgagatcgcaccactgctctccagcctgggtgatagagtgagactccgtctcaaaaaaaagaaaaattatgccaaaaaattaagtacttttgtggcttaaaagaacaatgtattgtcatttctcaaggctccatgggttgattgagttcagtttctcatttggcgtctcttgtagttgtagtgagttgttggctgaggcagaagccacctgaaggcttgactaggcagggcaatcgaggtggtacactcacaaggctggtcatttcctggggctcagctggaaaggtggaccagagttcctacacaaggccctttgatgtggtttgggtttcttacaacatggtgattgtgttctggaaggaagtctcctgagacttagcttttcctaaaggccaaaaatcagctattggggtctcatttgcttaaaattattggcatgttgttgaaattataatgagttttagtaaagcaaaattaaaacaattttcatgattttaatttcacttttttcatgattttctatgaaattttggtcctcattttaacaagattcctttttaacaatcttttactaaaaccagtcattcatggataaggagatcctcttacactaattatttaaatgtgtacatatacatgttaatacaaagggttgaattgttaaagcaaattcagagtgacttacagatcttacccaacatgaaactaatgattcaaatgataagaggcaagtgccaggcacaaatgaaacactcttttctggaggagaccaacagttttaattatttctggggtttttttggtcaaatttctcatgttgcttctagattgttttccaaatgtcatttagttttctatctgtactttttgtgattctctgaattctctgtcagacatttcggagatcttcaattcttctgggtccattgctacagctttgttatctcttttgatgttgtcgttttcccctgagttttcacagtccttgcacttcacgtcgatccccgtgcaattgagaagatagtcacctctgacagttttttaagggttcttggtggtgtcagagctttgctacttagtattggaacttaaactctggtctgttgtttcttcctgttctgagtgagacttgcggtgagcactggaacttaaacattgccctggaactatattgctgctctgtcaacatttcccagttcagggaagatgtaagtgggtatcagaacttaatcttgagctttttgttgtttccaggccaggggagggctctcgagtatacctaggctcgtggaaaatgcagccagggatttggacctccctgtggattgtgccagccagtcccttcaccatggtgtccccactgatcagagctcagagtgcaccagtacaccagttgctgcaatcagtgcttggctttttgtccccagttcaccccaggtcattcagctatcctggcattcccagtggttcctgtgggacggggccagagtgggtgtcccatgaagatgaccagatcagtggggagataaaatgctcacctgtaattctctcctgtcaccttggaaaccatggatctagagacattctctgagtgacactatgccagctgggagtggtggcacagtccgaattgattgtttctcttaccagttctggcttctttcaattctgtggacctagggggtttctcagcttctccccaaagttctggtgaattcagggtggtgttcttgtctttgaatagttggaatctatttctgtggggggaatggttccagagaatcttctattctgccatcttgttgagctctcccaaaatgtccccttctcctacattggcacacgctttggtttcacattgactgatgagttttgagcaacgtatacaaagaaacattgttctcaaaggaaactggtgaagtttgggggtgcctccattttgcacgttgttcattacacaagtagaatatacttatgtgactacccgtaccctttctccagcctccctgccccataaacctataaatcccaaatttatttataatagacaatcttgacagattaggtatatcctgctggaaataggactagttcactgagtataacgtttctacagagcagtctgattgaggtcttcagcatctttgcaaggtgccctggttgaggttattgttccgcaggcactcctgtggggaaggagtgatttgcaggcttcatgctgacattacctgtatggtacattttggccaacaccagcctgttaatgcctgaggcagaggcctctggaatgagaaaacaggactggaagcctgcctacttagtagcttggcaagtgtcaacaagttaatctctgtgactggtgacttagttggagttccacccaaagcagatcctgagacaaggatttagtgcaagtaattcatgtggccatcatccagaggagcatgggagaaagtggggaatttagacagggaaaggaggaagttagcaaagggtgagtgaaggagaacaagggcccaggacagtgaggccccacctcagaactgccctcctggaagggcgaaggagccgtggcgccgacccccacctcctgcccctcaatagggagcatcactccccgacgtcaactcccagctcttcctggcctgccctgtgctcaggccgagcatggcctaaagcagggaatatgtctaggcagagtgacacagggagccatgggcaggtacaggatctacctgcaagtgactacaggggtggcttcagggctgaccaatggcatctgctatcatggaattaaagtaacctaccccacgaagtagctgtgccaagtaagtgaaataatgcacaaggaaattctgtgtaaactttcaagcatcaagcaaatgttagttatttcttgaggacgttatgtaaagtgatataagccaggcccggaaggacaaagactgtatgattccactcatatgaggggcttagagttgtcagattcatagagacagaaggtagaatggtggtggccgggggctggagggaggagggagtggggagttagtgtttagtaggaactgaatttcagtttgaggagatgaaaatgttctggggatctattgcacaacaatggacatgtagctaaccccactgtactgtattcttaaaaatgtttcagatggtaaattttatgttatgtatattttaccacaataaagaagtgagttattgtactttcaaggcactcggtgtgtttctcaggatgctgggcagcccatggccccgagacaggtgccaagtcaatacttgggtgatgaaggatgaagacaaacctcctcttcatcttcactccagtgagtggagcactggcactgttgccagtgagaggcaaagacacgaggccaattcaacaacccacctcaaacctgtatttgcaagtgagtgcagactcccctgattccaatgaagctgctgttgagggccggatagcagccactcttggctttgcgggccgtacagtctgtgctgcaatgacaactctgtgggtgtgtgaaagcagacactgcttagatgaacgaggatggcggcacgccaacaaattcattatggacactaaaaattgaatttcatgtaattttcatgtcatagaaattctttcttttccccttcaaccatttaaaaatgtaaaaaaactattctcagcttgtgggttttacaaaaacaggtggcagccagatttggtagtggccggactttgccacctccagcctggagtgttttgggaattccccattctgaaatggtctccagtgtggctgcagcacgtccatttgacaatcctgacctcggtggtggcaaatcttccttgtttcctggtggatttaactttgcagaaggaccagcagacatcctgacccaaacctgatggatgagattggtgtaaagtggagaaattctgttttggattaatcacaaggagatttaaaaaacgagagattttctgtagtaagtacattgcctgtaaatagaattccaattctacatgctcagggaccattttgttcacttgtatcaaactatattctctggattcagagggaattattggaacttttcagagatcaggaataaaatgttcatgcatgagaattttgtgttgggcttttagaaggataaggatctcacatatggcttctgggtacagcatgaataaaatgcagttgctgacaaattaaaaaccagaacgttcctcatattgggttgattagcacttgcaggttctgtaccatcactatccttaacgaggaacataagccttgtcccaagttgcaggataaatatttcaggaactcagttgcaaaggtcagtattacattgatttattgatgtatgcttttaatcaaatgaaccctttagaattagttgcccttaggcaaatgtcagaagctcaaaacattccttaaaatacttaaaacaaaataatgacacaataaaacatcattaaaaatccttcaggctcattagctctagttaaagatggttgaatgcttatgataattgaattgagccactgagcacttcctgtctttcttcttccaagaggagagaaaatagatgagggctgagaagcagtcttccttctgcatgtgactaagctaggagcttgctaacccagtgagtgcatgacaatgctgatagtatttttggagggtttagcatccccaaatcttttcttttatttctacagaccaagaacaagggtatttccctgttgaattttaggtgtagacatatggaaaagaataatctatattatctttagatggataaagcttgcctatcagcctagtggcctgtgtcagtcctcgacgtccagccattttctcctccaggacagtggctcagcatcctctcccacaacgcttcgagcaatatcatgttagacagttcctgcttgctttgacttctccttgcagacctcctgcccagctggtatggcctgaaagcttgtgtactcccagattcatatgttgaaatcctaacccttcatgtgacggtatttggaggtggagttcttgggaggtaagtgggtgctgaagataaggccctcatgaatgagattagtgcccttgaaaaggaggcctcccattacctccctcaccccttccaccacgtgaggacacagtgagaaggtgctgtccatgaaccaggaagcagccctcaccagacactgaatctgccagtgccttgatcttagactttccagcctccaaaagtgtgagaaacaaatttctgttgtttatgagccacccagtttatgggattttgttatagcagcatgaacagactaagacaccaacttttgatcattttccttatttttcataaagttgctgaacagaagtgagggaagacgatgccagtgacagcagaacattgctgagggctgcagaaatatgacagcccctgggcccctgcacttcccctccctgcacagacaagagtatggtgaagaacggaatgaagttataacgcttgggaagtggcctgtgaggcctgatgagcccatgttctttctctcacgtggtaagaaatgaccccgagtgaccagaggggctcatcagagctgatctgagttcagtaaaagggctgatgtggaagatgaggcagagagtggaccttagatctcagaagtgtctgttggatgatggagaccttcacagagaacactttctcaggaagcgttcccagcagaggtctcagcccctggctgattcacagcctgcatttagaacggagattgagtcagaggagattccacctctccatgcattcccacagtcctgaaactagtcagtgttagaaccagaattcaaactgacggtctgagcccagagctctgctcttcatcttacccagtattacattcattcccatattgactgaagattcactttcactgttatcatgaaaagtaagttgagaaattgacatgtcatgtagatgctatgaggaatcactggggagagattaagatgttccttcaagcttcagatctttcagagagataagtagtgtggagttgcactgttgggaaacgagtcttggcgttctggctcttcacttgttcgcctgccttcctcctccagcccagctgctgcagtgtggcatgttacgcttacacttcatggaggaaatggaactggggctgctccaatgttctcttttcaggttttaatggaaggttctgcattcagctgcaccaacactgcttgcaaacaagaaaagaaccgagagagtggagaacactgtgcagggacttgggtatggattccagggagtatctggaaattcccacctcacaggtccatctcacctggtggttgttcctactgaaaaaggatcccgtggtcctgtgccctgagggccacaaacagcataaatgttccagagcagagcctggaagtgggagggtacagagggaagacataagaagatgggggtggaagcatgaagggcagttctaaagtgtcttggggagaataggagataaattagatgataatgcacaaggccaagggcatggcaaaataaggaaccaagaagaatgaaaccgatttgatgaagataaggattaacagtacacacagttatgaataaaagatgcattatgtaataattagcaggcatctataggttggtgcaaaagttattgcggtttttgccattgaaagtaaatgcaaaaactcgcgactgcttttacaacaacctaatacagcttctttcaccaaggagcttaaatgttttaaaataaacaaaatgtcgttatgcaccctacctccctccgcagtttggagcccttccttttccagaatgatgcagcccaggtccccctaccctttgttctcagcagcaagtctccggagaggttatatatatatatatatatatatatatatatatataaacaaataaatgatttacctttttgccttcctgtgtaccacattcagattttgcttttgaaaattccatcaaggcagctatgatgtccatgtttaatctacttatgtctgcatcaactgctaccctaactttttctctttatcactctcttgcaattaacattttgtcatacctgtgtgctacataatacatagtttttgtgtttttgaagtctataaaaatcatatcctattctatgtagttttctttgtattgttttttccactcagcattatgcagagtggttcaatgtctttgtgtgtagtgtagttcatttattttgactgctaaaatatattccactgagtaaatatactagattttatttatcctcttgtcagtggactgtttccaggtattttttgaaatgtggacatattgctatttaaacaacttttctatatatgtctccttgtacacttccgcaagaatttctcttgggtgtatacctaggagtaagattactaggtcagatttataaaacaataccgaagtgctttcaaggtgggccggtcagatcaagtgaaccaatttacactcccatccacgatatatgagtctacttccttcacattctctctgtacttctcaatgttggccaatctgcagggtgtaaaatggtataacgttgtgggcttaatttacatttaccagattacaaaagtggttgagcatcttttatgactcttagccatatggtatactgagttgaatagagtccctgcctcccccaaaattcctgtccacctggacctcagaatgtgacctgatttggaaatagggttttatagctgtaattagttaaattatattgatgttatactggattaggattgaccctaaatacaatgacatatatccttataagagaaccatgtgaagacagaagtgatatggtttggatgtgtccccacccaaatatcatcttgaattgtaactcccacaattcccacatgttgtgggaagaaaactctttcttttgtagattgctcagtctcaggtatgtctttaacagcagcgtgaaaatggacaaaattggtaccagtagagtggggcattgctgaaaagataaccaaaaatgtggaagcgactttggaactgggtaacaggcagagtttggaacagtttggagggctcagaagaagataggaagatgtggaaaagtttggaacttcctagagacttgttgaatggctttgacaaaaatgctgatggtgataggaacaataaggtccagaatgaggtggtctcagatagagatgaggagcttcttgggaactggagcaaaggtgactcttgttatgttttagcaaagacactaatggcactttgccttgccctagagatttgtggaactttgaacttgagagagatgttttagggtgtctggtagaagaaatttctaagcagcaaagcattcaagaggtaacttgggtgctgttaaaggcattcagttttaaaagggaaatagagcataaaagtttgggaaatttgcagcctgacaatgagatagaaaagaaaatactattttctgaggtgaaattcaagccggctgcagaaatttgcataagtatcaaggagatgaatgttaatcctcaagacagtggggaaaatgtttcgagggtatgtcagagttcttcacagcagcccctcccatcacaggcctggagttttaggaggaaaaagtggtttcgtgggctggggccagggtccccttgctgtttgcagcctagggatttggtgccctgcatctcagttgctatagccatggttgaaaggggccaacatagagcttgggacatggcttcagagggtgcaagccccaagccttggcagcttccatgtggtgttgagcctgtgagtgcacaggagtcaagaattggggtttgggaacctctgcctagatttcagaagatgtatagaaacacctggatgcccaggcagaagtttgctgcaggggcagggctctcatggagaatctctgcaagggtggtgcagaagggaaatgttggttggagccccccacagagtaccacctagtggagctgtgagaggaaggccactgtcctccagaccctggaatggtagatccactgacagcttgcaccatgtgcctggaaaagctgcagacactcaacaccagcctgtgaaaacagctgggagggaggctgtacccagcagagccacaagggcagagctgcccaagacaatgggagcccaccttttgcatcagcatggccccgatgtgagacatggagtcaaagaagataattttggagctttaagattcaatatgccctgctggattttggacttgcatggggcctgtagcccctttgttttggccaatttctcccatttggaatggcggtatatatccaatgtctgtacccccattgtgtctaggaagtaactagcttgcttttgattttacagtctcataggtggaagggattgccttgtctgagatgagacattggactgtgaacttttgagttaatgctgaaatcagtaaagaatttgggggactgttaggaaggcatgattggtttttaaatgtgagaacatgagatttggcaggggccaggggtggaatgatatggtttagctctgtccccacccaaatatcatcttgaattgtaactcccatgattcccacatgtcatgggaggaacccagtgaaaggtgatttaattatggggatggatctttcctgcactgttctcttgatagtgaatcagtcttatgatatctgatggttttaaagaggggagtttccttgcgcaagctctcttctcttgtcttctgccatataagacgtgcctttcaccttcaccatgattgtgaggcctccccaggtttattggaactgtaagtccaataaacctctttcttttgtacattgcccagtcttgtgaaaagtaactaacacaagaaggataagttggagtgaggcatctacaagccagcaaacaccaaagattgccagcaacctccaggagctgggaagagacaaggaaggattcttctctagtgctttcagaatgagcatggctctgccagcactctgacttttttcccctggtcaatgttaaaaaatttctctagcaagtccataatgctgtaattgccatagccttatataaatcttgatatctggagggcaattccctctgctgttcattttgtttaggataatagagcaactgttgccagggctctccccaaattcttttggattcatttgcattctccattgcactaccagttttttctgggagtacttcctaataaattactttcacatgtatctctgtctcagcgttttcttcggaacaaacttattttaaaaaacatcccatatagattttggaatatctcttcaggttacatgaaaatactgttgagattttgttctggaattatatagaatgtatagatcagttttggagcacaattgtggccttatgataagtatttttttacatgtgaatatgaaatatttttccatttatagttcttttaaaacaacttttaatagttttaataattttctgagtaatggtcttgcacatattttattagatttatttctaggcaccctctagtttttgttgctattgtagatggtggggggttgctataattatatttcctgttgctagtatgtagaaatgaaattgattttatttttggttctattttttgtgtatgtgcctggaaacttttggttgaattctggacactgcatataataaatgtgtctcaggaatgctttgtcaatctagagaagcctaaggactacttcttgaagaatatttttaaatgcagaaaataaaatctatgagattacaaagaaaccaattatatgaaaatgtaactgtattagtctgttttcatgctgctgataaagacatacccaagactgggcaatttacaaaagagaggggttcaattagacttactgttccacgtggctggggaagcctcacaatcatggcagaagacaaggaggagcaagtcacatcttacatggatggcagcaggcaaagaaagagcttgtgcagagaaactggcatttctaaaactgtcagatctcatgagacccattcaatatcattagaacagcacaggaaagaccccaccccgtgattcagtcatttcccaccaggtccctcctacaacatgtgggaattatcagagctacaagatgagatttgggtggggacacagagccaaaccatatcaggaaccctagttaagaatgctgcagttatgggtgatattattatcttcttccagaggtgtgtgctgcaagctttggttaggaagatagagtgagtttgatcatcttaatctaatcacgaactgagctaacttgaggctgatctgcactttggaagatgttgtctctctctgatttgcactcccctgctggggtacatctctccggaagttgcaaataggtgctcattttaatgttagataacttttaaccaagagaaaatcccaaccaccctgtgttttagggaatagtatatttggcagaagcaaatacatttccacagataatagcctcagacagattgtagatatcaagacatttaatcacagggttctgacatttaagaacttgggagtttggagttttgttggcttccagagataggcagaacttaataagccaaatcaattattctttagttttctgctgaaaaggctataaatagcattttacaagttctgtctgacatctttttatgaggaacattatttccaatatttttgtgacagaaagaacatttctaaatatatttgttaattaccaaataataaggcaaatgaaagatcagaggtcagttgccttccaccctttctttccatgattcaaacaaatgtttaagatatttttaaaggtacagttttaaccttttggttaatttacattgtattttggcaacagaaagggttatataatagtgcagcctccatctaccaaaaagagatctgaggggaaaaaaaaacctcactatttaaatttagaaatcttgaatgtttggttaagaaggaactgttttcccttttgacattttttacaggctttattgaaactggagctttatattctttttttaaaaagaaacaacaataaatatagtacagtactttccataacacattatttcagtggcttaaggtcagctggaagaaaaatgcagttctccacagtgtgtggctttaaagtggtcattataattctctactttattctccaaattagtgcaaacatttattgatcacctcctgcatgccatgcaccatgctaatcataaattatgcgatcctggttcagagatctttgatttcttaccacgctggagtgttagccatacaggactgctttgtgctaggcaagccagcaagtcaggggctcaaaaacaaagcagaataagaaaaatttcaacaaaacattcattttcaataaactcatttagcattttgcatccagaaggatctagaaattatttttactttcagcatacatataagttttgagttgtacggtttgatattgttctcatttgaagttcatagtgggtgtcataatcttttcagtacttgggaaccactaaagttctcaaagtagtttgcgttttaagctctgactttgccaagttgattgagagaagcttcagtggaagaaaggatacttaattcacccagcctgcttctcctttcctagtgcaccctctaccagaattcctgagctagggaaaagaaatgcaatgagcttggagacagatttttttttttttttttttttttttttttgagacagagtcttgctctgttgcccaggctggagtgcagtggtgcgatcttggctcactgcaacctctgcctcctgggttcaagtgattctcatgcctcagcctcccaagtagctgggactacaggcgcctgccactgtgcctggctaattttagtatttttagtagagatgaagttttgctctgttggccaggctagtgtcaaactcctgacctcaagtgatccactcacctcagcctcccacagttctgggcatgtgagccactgcgcccagccccttggggagagatttgatgcagaggacatggtgatttgaaagtgatcattttttccccaagagtttggacaggaacagaaagggtcaaaagaaagttctttaatgatacaatgaggactgctgtggtcagcttgaaggtttcaaggcaaatcaggaagaggcagccctgtacaataagctttactgggtgatgcttgagtggggctgcctgagaagagggggctccctcgcagcaggagaccctcccagaaggagaagagggcaagggaactccagggccagagagagtcaaagaagggccttatgtgtctaggtgacgtcactcagcaacaaggtggggaatgtctgggtcagagacttccaaagggccaaagtagtttgagatctgtgatggttaatttcacatcagcttgactaggtattgatatgctcagaaatgtggttaaatgttattctgttttatctgtgaaggcatttctggatgagatcaatatttgaattgtaagaccaagtcaagcaaactgccttccccagcgtggatggatctcatccaatctgctggaggtctgagcagaacaaaaaaggctgagtaagggagaattcactggctcggcctgaccatctttgcgccaggacaggggtcttctcttgcctttagacctggactgaaacttacaccatgggctctcctggatctccagcttgccaactacaggtcctgggacctctcatcctctgtaattgcatgaggcaattccttataaatctctctccctctgtgtgtgtgtatatacatagagagagaacacatttgctgggcatggtggctcatgcctgtaatcccagcactttgggaggccgaggtgggtggatcatttgaggtcaggagttcaagaccagcctggccaacatggtgaaatgccatctctactaaaaatacaaaaattagccaggtgtggtggtgtgtatctgtaatcccagctactcgggaggctgaggcaggagaattgcttgaacccaggaggtggaggttgcagtgagccaagatcatgccactgcacactagcctgggtgacagagcgagactctgtctcttaaaaaaaatatatttatatgtgttatatatgttatataatttataatataaattataacatatatttatatatgttgtatgttatattattatatataacatatataaatatatattatatataacatatataaatatatattatatataacatatataaatatatattatatataacatatataaatatatattatatataacatatataaatatatattatatataacatatataaatatatattatatgtaacatatataaatatatattatatgtaacatatataaatatatattatatgtaacatatataaatatatattatatgtaacatatataaatatatattatatgtaacatatataaatatatattatatgtaacatatataaatatatattatatgtaacatatataaatatatattatatgtaacatatataaatatatattatatgtaacatatataaaatatattatatgtaacatatataaatatatattatataacatatataaatattatatattatataacatatataaatattatatattatatataacatatataaatattatatattatatataacttataaatattatatattatatataacatataaatattatatattatatataacatataaatattatatattatatataacatataaatattatatattatatataacatataaatattatatatataacatatataaatattatatatataacatatataaatattatatatataacatatataaatattatatatataacatatataaatattatatatataacatatataaatattatatatatataacatatataaatattatatatataacatatataaatattatatatataacatatataaatatatataaatatatgttatataacatatattgtgtgagtacacatacagaatatatatagtgtgtgtatatatgtatagatacctgtgtatataatatattagaatatgtgcagttatccactgcataatgacattttggtcaatgatggacctcatatatgatggtgatttcttaagattataatggagctgaaaaatcgctattgcttggtgacatcattgcttctgtaatgttgtaatgcaacacttgattcatgtgtttgtggtgctgcttgtgtgtacaagcctactgagctgcaatcatataatagtatagcatatacagttatgtagagtacacaatacttgataatgataataagcaactatgttactggtttatgtatttaccatactatactttttattgttattttagagtgtgcacctatttattaaaaaattaactataacacagcctcaggcaggcccttcaggaggcatccagaagaaggcattgtgaccataggagacgacagctccatgtatgttattgcccctgaggacctcccagtgggacaagatgtggagttggaagacagtgatatggatgatcctgaacctacatgggcctaggctaatgtgtgtgtctgtgtcttagtctttaataaaaagtgaaaaaaaaattttaatagaaaaaagcttatagaatagggatataaagaaagtattttgtatagctgtacagtatgtttgtgttttaagctgaatattattacaggagagccaaaaagttacaaaaaaattaaaaagtttattaagtgaataagttacagtaaagtaaggttaatttattattgaagaaataaatgtagtgttccctaagtgtacagtgctcataaagtctatcatagtgtgcggtacagtcctaggccttcacattcactcaccactcactcactgacatcagagcaacttctagtcctgcaggcttcattcgtggtaagtgccctgtacaggtgtaccacttaaataacttttaaaatacccttcactctgatgtttgcataatgacaaaatcgcctaatgacatagccctgtagttaagtgacacatgactgtatatacattctatcatgtatgtacatatatgacattatgttaatataaagactaatacagcgtagttcataggaacaaggttcatcttacctgtggcttagcagatgttgggcacagttttgtgggctatgtaaagtaggtaggctccaaattgccaaaaatagatttctctggactatatttaaagcaatcaatgtggaagaatttgagtttggtgccagtgggctttgagctagtggtctagcctgctgtgaaggcctaaacaacattgtaggccaacacacgaggccacgtctggctcatttatataactgctatggaggaaaaagaggagagtctttcatcagtaaacatctcagtagctaatggtgctttccctaattctggggttctttctattacgaggtggcaatgagcttgcggttgtatgtttgctgtaaactctttgtcacccttgcttgtctacaccacaccaggctggagagggaagcgagggctcaggtaacggtggcagcagttataaaaatagctgaatcctctcggccaccatccccgttctggattttccctggcagagttccaggcggttccacgtgctttccctggctagcagccagtttagtgcacccactacagccactggtgtgtttgcttaaaaatgtttttcttgttttctgattaaaatatgtgaaatgcttatcataaatcatctgggaacaggaaaatagagacttaaaagtgacctatatcatagataagtgctaacactttgatgtactttttcttagtcttttaaagggcatgtttataatattgaacatcattactgctttgtattcaggtttttgcacctaagttaagtcatatgcctttcctgtgtcattaaatatgtttttgaagcatatttaatgctagcatgaaattacactctatggtcatagtatgtttgtccagttattggacattcaggttggtacccaactggcccactggtagccaatgctgcagttgctactggggcccaggccacccctgctgctgtgcctccagatgagactggaaagggctcctgccccatcagtgttcacactcctacacatcaaagtaaaaagctctttcttggtttctttctgcatctctgatcttatgacatttcattaagctcattctatcaaaagaatacaaaccttctctctgagaactggtgaaacttccaaaagccaataaaaacaaactggtttggaaaaggagagaaagcctgggctgaaaaaaggctacaagggtgacaactgaggcactgtctcaataaggacactgtgcagaaacttgatgtgttcaggctaaatttatgccagagcccacagtgggccacttcacacctgtggctgttattaaagaagaaaaataacaaatgttggcatggatgtggagaaatcggaaccctcatagataccagttgctggtgggaatgtaaaacggtatggttgctgtgaacacatggagtggtttctcaaaaagttaaacatagaattaccatatgaacaaccagttttactcataggcatatacccaaaagagctgaaagcacggacttgtacacatacttatacatcaatgttcataacagcattattcacagtagccaaaaggtgcaaacaaaccaaacacgtgtcaacgagtgaatggatcagcaaaatgtgaaatatacaatggaatattattcagccttagaaaggaagttctgacacacgctatgacatggatgaaccttgaggacaatatgcaaagtgaaatatgccagtcataacaggacaaatgctgtatgcctccacttatatgaggtccctggagtactcaaatgcatagagacagaaagtagaatgctggttgccagaggctggagggaggaggaagtggggagtgagagtttaatcattactgagtttcattttttcaagatgaaaaagagttctggagatggatgatgaagacagttttacaacaacgtgaatgtccttaacgccactgaatggtacattaaaaatagttaagatggtacattttatgttatgtatactttatgttatgtatattttatatataataaaaagacaagaacaacacagtgggttgcacagcagcaggggtggagccagaggctggaatctattagaaaagtgaaagactgaaaaaaaagtcaaggttgactgaagtcccaggacagggattatgcccatcttgttagtatcatatcctccaatctagactagcacctgacatctagctcaaggtttagtgaataaatgaactaagctggaaaagataagcacaagctcagggggcaaagtaagtccactgtgccagttattatgttatccctcaataagcagctgtctatgctcagctgtgtgatgctcgagctaaggctctgcaaacatgtctgctatgccactggctctctcttaggttttgctaacagggggctcaagagagaaggctggaggaggaggaaagggaacacactcctttctgcttgctccctatgggatccatgtctgcttgtgatcctgtgattctcatcttaacgatcttcctccagccatgcttcttcaccctcgcagctggaagtccttccgtagcagcagctgaggccactttgcagttgttccagcacaggcagcaccagcatcatcagattgcacttcagagatcccagcactttcttgctgccaggaaggtgccccttcctcagaagcctggatcccagcaaaaatggtgtctcctctagatttactagttttaataatgcaaatccttccctctgtgccctcagtcctaggaaatctgttcctgtgatgctactttggggtgctttagttttcctcttggcctttcaatttagttaacaaaatacataaatacatagataaaattactcatgctcaacaattgtcaacattccatagttcctttttatttaactccactcctgtcttgttgttgttattcgtagttattgctgctgaagaattttaaagccaatcccagatggtgtgtctcccataaatatctttgtgtgtgtctttggaggttattcttgagctaagaaggggattttctcttaaatcaagtgactattgaaggtcatgcccttaaatcaagtgaatatctttgcagataaagatatttgacatggacatgcaggagaaagggatgctcccaggcctgccgtatcagcaaccaatcagaactactcaatggagtggcagctcctatgaccagatggcctgggcagctaagtctggagttcaaaaaccccagactccccatcacttgatggagagtgagtaattcttttacttactagggcagatcacatgtatatttttggccccactttatcagatacaacccattgtttcattggttagatatgacaaaatgacaaaagtttgagtggccaaccaacgaagactagtcctgtgcaatattgataggttggatactggtagttactgctactgcaacatcagatatgagcttccaagcaccactctaaggaatagagggactctcatttgccaaatacattgacaagtaatccaaaaatacactaaacctttctgagattgaaaactgaagaaaagagattgtcatgaactcaaaagacctttttgataaaaagaaaagtgttagcataactttgacttggaggaagagcattgtggctctatgaagcagcccacagcttggccttatgcccaagatccttgtttagcagatgctagagaggagatgcccaattccccagctcctcctccactatgatcttttcagaacctttaaaaaatctgtgtcacagcagataagaacttaagggtgatctcttttcctggtgctgtctctttgttctcctggagcttacctgaacgggaattcaccaccagggttttgaatctcctggtaagttccactcgatggttgactagcatcattactaccttagcatggtcaggtgcttgctgtctcctctttcaatattggttttgaagggtcacctaagcagccttctttaccaaatgaccaaaaactgcaattttcctaattccacagctagacaagccctggaaccaaccgaactcccagccgccaggctgcagtgcaagagctaagagtagtttggagaaagccacatgtgcttaagagaagtcaaagaggcaaattcaatagagggagcaatgcacagggcccaggatccagaaacctggagcaggatacaggtattacagaccagaagtaggtttagagggccaggggaagctgatggggaatgggagagaggaggtgggagacagggagacggatagtttcctgggctgtttggtccctttcttgggtgatactgcatttatctgcaaggcacagaatttgttgatgaagaacacaaacattggagccccaatgccagaacctatattctggatgtaccagcacactagctatttactccaaacaagtacctgaaccttctgtaactcagtttccttatctatacatgggggatcattataatgtttttctcataggcagttgtgaagatgaactgagttgccatgtgtaaagtgcatagcatagcacgtagtacacagtaagcactgcatccgtgtcagttatgatcacctctaagccctcagggcctcagccatgggtgagaagtggttatggaaacagaaatgcctcaaactggcacccataatgcttattaaacatgttacgggcagctttcacatgcccaacctgctgaggttgcagagcagcccttatgatctttattctacacaggagaggctgagactcagagaggttaacttgttctgactcacacagcaagctggtggcagaattcctaagatgtagcactatacatactttctgctccacttgcatcctccctcctcctctgcccccttagccttcatggaattgtgggcatccctaagaccatgcctggtgaaatcggcatcaatttaataaaaagcagaatgcaacgcaagaggcaaatgcctgactggcttctgaggggctgagcagtgacatgctacttataggacctttctatgcagctgctctgtggtcccaggacccctgtggggtcctgagcagctgtgatccaaactcaggagctgctgctactcttggaagctttggtgctcctgggccacagatgtactggacagaaatcacaaggtcaaggaaggagactcaagcccagagtcacctctactgtgcccagcatagtgctcagcacaaaactggcccctttagccactcatttatttacaggtaaacgggggcatttgagtatataatctcaatgcaaaaggctgcatttctcttatacgaaaagacccttgagagtttatatgtgaaaggagaaaaagaagaggaggaggggggaaatagaaaccaaaaactcaattcttttcttttctttctttaacaggttcatatttgctgttctgttgttcttggtcgtggcagtaattcaaagtctcaagtatgcaaaaaccagttggaaatgttttaaaagggcagccaagtaggcatttctcttccaaataacaagcttgattccactgttggatttttaaaaaacttttatttatcttcaccaattatttaactttgattttcatgccttctcactgaataaatattcctaaataggttaaaataacagagaaatgaaatcatctaaagacattagtcacacagtgtgctctggtgataagactcctggactgcatgaggaaaaagtgttgcttctggccctgccatgaagttgttgtgtgatcgtggaagccgttcaccatctctggacctgttccttcccctgtcaaattaaatggggagggctctcaggtgggcaattactatttttttgatgttcactttctatctcctttttcttttggtaatgagaccctgtatttcctttggggaaccacccctcttctacagtcagtcatttagttcagctgggggaccaccatgagcttgagatgtgggatcccctctgtgacagtgggagttggaaaggatgcttctcatagcatgaaaggataactagaaacaacatttttatgaaagtaaaaatggctagcaagtcaaactatttcttatctcctgtattagtcagcgactgctgcgtaacaaattactatgaacttagcagccagaacaacacacacttattatctcagtgtttctgcaggtcagaagcctgggcatggctcatctgggttctgagcttcagcatctcactaggctgaagtcaatgtgttgactcagctgcagtgtcatcagagactcaaccagggaaggatccactcccaagctccctcagcttgttggcagaattcatttccttcttcttgcagggttgaggctttgcattcttgctgaagctgctctcagcaatggcagtttgcctgcagttccttgccatatgggcttcttcaccatggccacttacttcatgtcagatttttcaaggccagtaagggagagtacagtatgtctgctcctaagagggagacttatatatatggtaacttaatcataaagggacatcccattatctctgccatatcctgttagttacaagtaagtcccaggtcctgcccacactcaaggggaggagagtacccagaggcatgatcccagaaggtgggtgtctttgggggtcactttgggtctttccactacattctccattgaaccttctatgtggaaagactgacttgacatgtcaatgaatatttaatgccttctccattccatttggtaagtgtctccaagtcttggactgacactgcccttattgtacatactgttcaatggttttatcttgagttccttgtgattttattgtagtaaaaggccatttatggaattccactctgtagcatgcattgttgtgttcaggcgccaatgtatttgctttcattttaacacttgggtttagtggatggagtttctcctgggcaaatctgtgacccaggaaacacagcaacctggttggtgctagtgtgtgacagagccctgtgtctttgtgtttacccgtctgtgagattatcccattagtgggacactcctcagtagaagacctttctcagcagggggctgatccccaggtcacagaatggatgttttcatatcctccatttgtgttatgccagagcagcggtgatagatgatgagagccggaagtcctcttctttaacttcccatgcttccataccttccatcagcactgagatttttagattctcctgtgaaaagactttcaagatctgcttttcttatctctgattaaaccagaaagaaaatgacttgaccagggttgaggagaaggaggaacaaagggaagggtgtttgaaccaggaagggttgggggagaaacaaaaacacgtttgctcctgctgcatggagccatctatggctgtttcacagcttgaagaaatgcacacccaacaaataggagtctgtggaagactgaagatttatggtcatttttcagttgggaagataataaaaaaagagagccgttactttttataatggctaggctgtttttcattagttttaataaacctttcctttccctaacttttcttctaaacagttacttggacctttaacaaaaaacaactttttattttagaatagttttagatttacaggcaaatcacacagatcatacagaaggttccacgttccctgctcccctaactttctgtccagccctgcccattgcccagtgccaggctcatgcaggtcatcaataccatgctcctagggagacagagctagagacagcctcttttcctacttccttcttagcatgtaactgtctcacaatttctgaagatcgagagtgatgttggaagagggaaatgagggacgggaaggaggtacaataaattctttaatattcccaaatgtgattttaatgtctaatttcagcccccgtgtctggaaatctttacagaaactgctagcaagtgtccagaacgagggacaccccgtagtccttgttcctacaggagagggcactcctccttgccagtgggagtggctacatgaggcctttggtttgctgtcagcttggctctgaggctggtttggggagccaatgatggatgaattttctgcagagcttcccatcatccacaaaggcccagaaaattctctgttgcaacttgttggcagcagtgctaagaccctttgagcaaaagacaggtcatgctcacctttaagaagaggttgtaggctttcccccttgacttggaaggaaaaaggaattccaaatctccaggataagatggacctcagagccatttttaaacttctcatgctcaaattcctctactgcagtcaaaacagcatgccattggcataaagatagacaaatagattaatggaacagagtagagagtccagaaatatactcacacatatatggacaactgatttttgacaaaagatgctggaacaggtgcaaaaaaaaaaaaaaaaaaaggagaagaagaagaaacttagctccttgaatccataatttaaagtgtgttcaaaaactaacaaatgttgggtgcggtggttcatacctataatcccagcactttgagaggtcgaagcaggtggatcacttgggcccaggagtttgagaccagcctaggcaataaggggagaccccatctctactaaaagaaatacacaaaattagccaggtggggtgacgtgcacctgtagtcccagctactcgagaggctgaggtgagagaatcacctgagctcaggaagttgaggctgcagtgagctgagatcatgtcactgcactccagcctgagcaatgggagtgagaccctaaaaaaacaaaaaccaaaagctaacaaatgagattatagacttaaatgtaaaatccaaaactatagcatttctacaaattataggagaaaacctttgttaccttgggttaggcaaagaaagatttcttacatacggtgtcaaaagcaccatccgtaaagtaacaaagtgatgaactgtactttatgaaaattaaaaacttggccattgaaaaggctctgttaagacaacgaaaagataagcaataaatgggcagaaaatattcgccaagcatgtatgtgaaaaggactttatctaaaatatataaagaactctcagaactcaacaatgaagaaacaaacaagcccatttaaaaatgggtaaaaactttgaacagacgcttcacaaagaagatatatgggtggcaaataagcacatgaaaagctgttctacatcattagacattatcagtaaaaccacagtgagataccactacatacccattaagatggctgaaatttaaaagtctgatgataccaagtgttggcaaagatgtagaaaaactggaagtctcagacactactgatgggaatataaaatggtacaaccatctttgcaagtagtagacccaccatgtattccatgcattccatccattccactcctagatacttaccccccaaaaactgataaatgtccaacgataggtgaatggatacactggtatacccatacagtgggatattattcagcaataaaactgagtgaactattgatacacaggagacaaatgtcaaaattatgctgagcaaaagaatccacataaaaaggagtacatactatatggttccatttatattaaattagaaaattccctctaatctatggagacagaagacagatcagtggttgctttcggggggcagaaaggtatacaaaggagggacaaaggacagttttgtgggggatggatgcgttcactatcttgatggtgctgatggttttacgggtgtatgcatatgtcaaaacttaccaagctgttcagtttaaatggacaatttattgtatatcaataagcaagtcattgcatgttaatgataccccaataaagctttttaaattaaaaaaaaaaatcccttactgaaccactgccaagagcttttcagcaaagctccctttatcaaaatcagagataaggcggtgccaaaactgcaaataaaatggagtcatttgtactgaataagaggaagttttccagtcacatgagttttctccagagggattcagtcagtgggactgggccagggtgaacagcagggctggcaggtcagcaagtccaagaggcttcactccatcttcaagttgagtgttctcatcgctaagatggcagccttggataagatgacctttaatacccaagacttcatggcagtggaaacactgagcattttctattggtctgggttgggtttcgttctccaccaggcaccggcactagtgctggcctttgcggccctcaactccttggcatgtgtgtcctcagggtcaacattagccccttgcgcctgtggggaggattcatggagtggtgtcaaagagtgcctggcttgttttcttccttttccttattctagtgggaatgaagttcagtccaagtcagacatgccagaaattgattttttctttacttttctggtactgaatttaatttctactttgagccatcgacccactgttgagtagaaatcaattaatttggttggtgcccttcctaagagtaagttctaagttgaggaaagtttatgtggaggcctctgggcatgacgcttgctggggtcttgtcctcatcaggggctactcagcagtcggtgccctccaccttcctctagctgagcacccacggctcatgattcgatcttcccagtgcagcctaaagcctcttcaggttcagctctccttggtgtcttccacgctcagaagtctgaggcatgtgacacagtggctcatgcctgtaatcccagcactctgggagactgaggcgggtgggttgcttagggccaggagtttgagaccagcctaggaaatacagggagaccccatctctacaaaaaataaaaataagaagttaaaggcatgggcttcagagactgtttggatgggaggaaggtcccacatttcccagcaaaggcaggaactttgtttttgcatctgaaaacaacagtgggcattaattaaaaatagtttgactcagatcgggcatggtggctcacacctgtaatcccagcacttcgggaggctgaggtgggaggattatctgaggtcaggagttcaagaccagcttggccaacatggcgaaaacccatctctactaaaaatacaaaaattagctgggtttggtggtatgcgcctgtaatcccagctcctcaggaggctgaggcaggagaatcacttgaacccgggaggtggagattgcagtgagccaagatcgtgccactgtacaccagcctgggcgacagagcaagactcagtctcaaaaaataaataaataaataaataaaaataaaaatagtttgtctcatagggttgttgtgaaaattaaagcagtcagtacttagagcaatgcctggaatactgtgagtcttctgtaaatgacgtttattttgtcacactggagtcaggggagcttgtctgcccttcttcctgggctcctggttccttcaggctctacccaggaaaggtggctcttgggcttctgatcttttctcttcaaaatgatccggggattctagggatggagagggcagggcttccatctttagagaggtctagctccagaaatcttcatccagacttggggagaaagtgcaagagaagaaagccttgctactccttgtcgtgcattctccgaaaaaaatacattcaaaaatatctccaccagtctttcaaaatgcaaggccaattactaccccttttctgtctgcgttctaccatcctttgaatgagccacaggtgggggtgccctgggtgactgcatgtgggtggctcaaggacacagggaaatggagggggaagccctgactaacaggtccaaatgttaacttccatctggttctctgtgggctaagaggaggcacctagtgctaagaagctgccagcagaagatgccctggcagcctgaccacccacaagtcctgacactcggatggccgcagtccactcctcctgcaggagacaggacctactgtgttagagtctctggtggcaggtgctcgggagatgggcatcacctgtcgtgtaacaccctttgcaaagaccgggagacatggtgaggatggcctgaaagtcaagtcaacttctattccattttctcctggggacgtgcaatgtgctctaagggcagcctagtgggtaggctaccaatgttttggaagataattcaaactgaaaacgttatattgaagcacgatgtcattctgccatcttgtggcagtatcattctctggattctgtggtgattgtggtctgtggctgttagagatgtggacttaccctgatgaggacaagtgcttagccctgcatgatgtcttactaactaccattaggctttctatgaagaatggattatttaaataggaaatctatcattaagatgaatctttgaggtgtatgaaacttcaaatattcatttagcaaatatttatcttcctatatgcatggagcaatcctaggctctggtgaaaaatgtgtaattatagtctccgtcttcaatgagcttcaatgagctagagaataaggacagttttcacacatacctgtaatacaaggcaaaaagaaataaatgtgtgttatatgaggagctctggataaatggaaagaagttaacagcactggacactgggaagggtgatgaagaaagtggtgtttgagtccagggagtcactgaatatctttgagtaaaggagggacataagaaaatctgtgtggcaggaaggtcactgggctactagctactagagcagtgatccgcaaactttttgatcaagcacctctaacaaaccaaccaaccaaaccaactaagtgagcatgcaaccaaaccaaagcattttacttaagaatataaacatttatggatctagcatgtacaaattaagatgtatattaaaataaagagattaaagtgatttaaaaaaatagtagcccaagtattttcttcttgcatcctattggatgtccgggtcccctgactttgaagattgctgttgtagaccagtttgggcaggaaaatagggaaaagagaatcagaaagaccctcgcaggccatgatgatagtgatagcgcagacgagagatcacctggacccaggtaaggtggagatgcaggcaatgtaaggtaatggacagacactcagagacagaagtagagaattgccaggagcttagggagagggaactgttcaaggtcattctgggtttgaggttttgttttgttttaaagtcttacgctattggaaagatgaggattcattttagagagagtacaggggtaaaaggcaggtttgtgaagaagatggtgagtttgttttgtataaggtgaggtttttgcaccagtgaaatctgtttgtctgtccccagaaatctggagatttaggactggactcagaaaaggagtcccgaatggagcagtgtcatctgattcagatgtgatgtcaaacttcaggaatgtgtgaggacacccagggcaagagtacagagtgagaagaaaacagagccaaggacgaacccacaaggacactggcatctaagcgtgttgtagctcagggttccttgagaagtagactatgagatagaaacttatgagcaggaagtgtattggggagtgttccagaatcaacaaccgtaaggagggaggattgctggattgggtggagaaagaagtggaagtctgatgtggtttcaacagaggcctcagctgatctcgtgaggagctctgaaatgaggagggcccttcgagggatggctgtggtgcgctgaactgggtcccctggttcccaccagctggattcctgagtcagctgtgtggatctcctcccaactcctcattcagtgatgtcaggttgatcttgacattggcacagtgggaatatttacaccatgaaaattgcccaatattacaaaccagggcttcccccatccaccaggaacaacttgttaaatatgtaccagtatacacatttatgtccctaatgaagaggggaactaagtctctgcatcttttcataaactgatcattggatgcaggctgcccctgaggagaagatgttactttggatggggtagccgctttcagctgaggactgtacctagagaagaacatagctgtgaagcataaaacatttcctaaatctggagaaattagtgtctttgaatgtgaagggtgaatatgaacaacataccacagcatccactacagcctaccttttgcccaactgcttcatatagtgatttaatctcatctagaaacagctacttcaggatcttagttactctcttttcctgggtaaatttatgacagtaatattggttgctatggtttgaatgtccttctccaaactcatgttaaaatttaattgccgttatgacagtattaagaggtgggacctttaaggagctattaggtcatgagggctctgccctcataaatggatcaatgctgttattgcagaagtggttttgctattgcaggcattcagccctcttcctctttttctttacactcactcaccctcccactttctgccatggggtgacacagaaggccctcaccaaatgtgggccacttgaccttggacttcccagcttccagaactgtgagaaataaatctctgctccttataaattacctagtctgtggtattccattataccagcagaaaacaaaacaaaaagaaaattggtaccaggagtggggttgttgctgtaacaaatatctgaaaagtggaagtggctttggaactggataatgggtagaggctggaagaattgggaggagaaggctagaaaaagcctacaatgccattaatggcaaatctggtgagggcgcagaagaagaccccagaactacagacagcctaaatcttagagattacttaagtgattgtgatcagaatgttggtataaacaaggatagtaaaggccattctgatatctcagatggtattgggaactggagtaaaggccatccctgttatatggttgcaaagaactttgcaggattatgttcttgtcctaggactttatggaatacagaatgtaagagtaatgagctaagatatttggtagaagaaacttctaagcaacagagaatcaggctgctgtgtagctacttttaaacacatccagtgagatgtgagaggccagaaatgacttaaagacagacttttgtaatgaaaagaaaagaagaatggaaagatttcagaaatttgcagcctggctatgtgaagagtagaaaggtgtgtttgggagagcaaatcaagggtatggtcaagcaattgtttgcttaagagattagtatgaacaggaaggaagccaggtgctattcatcaatacaatgggagaaatacctcaaaggcatttcaaagatctttgaggttgtccctcccatcacaggcctagggcatctaggagggcagaatggtttcagaggacaggccagggcactgtccatgggttcactggccagggccacttcaggactctgctctctgcattccaatataatacccctcatctgtcccagctgtggctcaagcaggctcaggtgcagcttggactccacaaggtgcaagcagtaaaccttggtggcattcacatggtgttaagtctgcaggcttacagaagaaagagatatgggaacatagcaaccttcacttaggtttcaaagaatgttcagacaacatgggggcccaggcagaaacttgtttcaggggtagagctaccacagagatttcctactaaggcaatgcctagtgaagccattggaacaaggccagccctgagagtcctcacaagggtaatgcctgatgggaatggcatcaccattgagactccagaactgtagctaccagtgtgcgacaccagcctgggagagctgcagtcatgagactccaacctgagagagccgaagtgtagactgagcccagcaaagccatgtgggtgaggctgcctgaggccttaggggctcaatctctcacccagtgtgctctctgtcttgcatgctcattcaccctttcatcttctgctattaggtgatacagcaagaaggccttcaccagatgctgacaccttgatttgggattgccctaatgtagcattcccagcctcgagaactgtaagaaatgaatttcttttctttataaattacccagtctgtggtattctgttatagcagcataaaacagtccaagacattagtctcctttgctgcaggtgaggccacaatcactattcatcatctctctcctttagtagctattctagatctccctcccactcagccagcacctgtgctggtctggtaaccttacatgaccctggtagggtgatctaaaccctcatctctaggggttggaaatcttggtaatcatgcccttctcaggctgtggctgctgcatcatgtctaatcgctattagaattgggcaaagaaataccaagagacaccctcatgaactgccagtgtacaaatatgttcttccacgaccccgacgtgtgagggcagaccctgctgctggtctgatgaatcctttcctttgcagctgctctcttggcaccaagagacatgatggcagctgtggccccagtgaaagcgttccttttctgggagccagggcctctcaccccacaaatacagaatcctcctggagttcattcatccaaactttaggaagtgtgttccatgcacagtgctcttcaggctacgagaaaatgagcctgggttctgtttggcgggaggtgaaccattaggaaccattggactcagaacagaacccattgaaatatgccccaaagtgttgcctgtggtgagtggagattctcttctctcactaactaagaagactaagagaagagaagcctgaaaaatgtgatttcttctgtctcagcagggcctggtcgggagtcactgggccccctctagaattaacatcactgcatgtaaacattagggacagtattttttttttaaatcctgcctaggtataatgttttcttttccattagtaagtaaagcatattctcttaagtaagctatgccatggataatatggaatttttgttataagcctttcccattcatcatactccccaacactgttttagatcttccagtcctggttttcggataattccaggtgcactatctcagaggtataaaaattcccaaaatgaaattaattttaattcatttaaaatgccacaccacacagctattaaggatggagaagattagagaggaaagaggaaaattatctgcacaaaccagagaaagatgccatcattcccaaaatactgggaatgataacacactgctttgtagtccctaattgcaatttcccagggggtgctatttttaactctgtggctgaattgttgattctttaatgcttctcctgactttccatggtgtttaccacaactaaggaatggtaaggggctggcgaataacaaatgatgaatggaatcacttgattcttacctgagaaaaggtcacagagaacttcctatatgaacttgattttcagctctgtgatgaataggccacgatagattatcctacagtatgacccaatcttgatgttaggccatgtaacaaatgtctaatctaaaaatttcctcctggcatttatctctcatttctctctctgtgcttaggaaaagtggaaaataatcactcattggaaattatcttctcattcattgatttattaactatttcaatgaattcctcatacatgtattacgctaggcatttgcatataatctcgtgaatcaaacatataaataaacaagtaactataaagtgtgaaatgctataaacttaagaaaaaaaaaaagaatgttgagataaagaatgagatgtgcccagaataactatttaacccaattgcaactgacctcaccaaatctgagaaggagctggtatgggaaataccattttttctagaagaaactgtacacacataaaccccaaggtaggaaagagcttggcaagtgtgcctgtcaaaaaggagacccagtaggacaaaagcttggttagagatggagaggtggaaccagagtcttaaaggcctgaggccagagtttggattaatttacaaatgcaaaggaaacaattacaataattttagcaggagatcgacagtaacccacaaaagccataaattcccccatccacaaactcaggtgtgcagaaatgtgacttctctaaaactgaattcaacttagccaacaacttttttttcttctgatggaggagatctatgtcttgccatgcttcaattgtctccagtttactagagtttcttttgagaaaccactcagctaacccaagattctttccagcctctccccttcttcctttcatcccaggtggtgcctgggttcaggtgagatgactacaaagggacctgaaataagcctccagagatacccctcttttgccaacaattagggccttggtgccaacacaaacatgcctatgctcactcagcctcgccaggtgagcgggaatctctgtggagtctcctttcagattttgaatctccctgatttttggtttgagattcaaactttactcaactgacctgacttcacacctgacagggctggaactgaagttctgttttaaagctttaaggtgggagcttcgcttgttaatctctagaaattctgctgactgcgggtttgtgattttcacttttctctgaggttcaggtattgtgtgtcttactcattaaagtttacaaccttttctcttggtcaaagagaaaacagttttctctgaaaagagaaagtgatatccttgtggcttaagtgaaaaatttgtaatctgtaaaactggtgggattctgcgacttagtgcaattgacagatctaaaatttcttcttgagtgactgaaattcctcccactaggtctttttggtctttcaaaggaaaatctaaattatggacaattatactactaaaggagagatgtgcctttagaaatactgcctggatgcatgtgcaatactaataatacctcttcattcatatagtcacaaaaatggtctcacataacttatgaagaccccaagttacaatggccaaaatggggtatctttaaaatacctaaagtagtttatctgtgcactcaatcagaaaatgctgtttgaaataaaacaaaataacgtatagagctatcttcaatgtacttagaagcttctaggccaggtgtgatagctcacacctgtaatcccaggattttgggaggctgaggtggaaggatcacttaagcccaggagttcaagaccagcctgggcaacatagtgagactccatctctattttacaaagcttctaataaagtcttttatttgcaagaggaaaacatttgtctacaacaatttctgaattgaaaaaagactgccaaaattgattttcagttaggttctctttagggaacatgttttccttttggttccctcagctcccatccacctgacaggcagagacttttagaaattatacaacacacctatctctttctccccaaagggggacagttatcccgtgtggttgttaataaattgcatgccatttcccccattaatctgtttttgtgagttgatttttttcagcgaacattcagagggtgaggggaaagttttcccatggcccctgcagctttagcgctatgagcagagtacctaacctgctctgctctaagccacagtgaagggaacccaggacctgacaggccagcagaagggtaagaacgtcttaccagccagcctccctgtctttcattttgtggaatctggttgagcggacagtaaaaccatgtttgtctctttttcctctgcaaaatgttggctaatgagaggaaaggatttgtatgactagtcttgggtatagcaatcttggtgtacttcttggtacacatatgggatcgagttgctcttagaataagtacatcattaaaaattctaatcatcagtggtcacgagatggatcctttgaattataataacatatatatatatatatatatatatgtatatatgatctctcattctaaacaaattgcctatttgtacttatgggaagatcagattttttttttcttttgagactgaatcttgctctgccaccaggctgctggactgcaatggcatgatctcggctcactgcaacccccgcctcccaggttcaagcgatcctcctgcctcaaccccccaggtagctgggattacagccacctgccaccatgcctggctaatttttgtatttttagcagagacggggtttcaccatgttggccaggctggtctcaaactcctgacctcaggtgatccacctgccttggcctcccaaagtgttgggattacaggcgtgagccaatgtgcccagccgagatcagattttctaaaagacacataatggtatcatggccagctttagaaattctcttcacaaaagtaaagagcaaaaatttgaccaaaaacaaagttaaaatcctttgtaagctcaaggtgcctgcttcagatgccctgtgggattcacagtgaaagctgctccacctggaattctggaaggtgaaatcctgtaccttcactgccatggccttagtcagagaaccatccctttggtttggtattttggtgacttttggctttggggatacctgtttgttattgaccctgttccctttcatggacagcttttagtttctcgtctttccattggtgagacacagggggccttcgggccttcaggccttcatgtgtaggtgctcagctgcccacaaagccggacagaatgtgagttgtacgccatttgtggttagtgaaactatcctttcattgagctgtctttggggtggttctgaatcttgtgaggactgctttgcccctcttcggagacacctcatgagttcttgattaaattacaaccttggttaaggcttattggttttggtaattcacttgggagggtacttgggtgaaaaaaaaaaaaaagctcaaaagccaggaatctcatctgtttgtctcagcaataatctgataataagagatttttaaaagagtttttaaaaaggagctgtggccaggtgcagtggcttacacctgttgtcccagcactctgggaggctgaggtgagaggattgcttgaacccaggagtttgagaccagcctgggtaacacagtgagatctgtctcaaaaaaaaatttaaaaattagcctcgcgtggtggtgcgtgctagtggtcccacctactcaggaggctgagcgggaaggatcacttgagactgggagattgaagttgcagtgagctgattgtgtcactgcactccagcctgggtgacagagtgagaccctgtcaaacaaaacaaaacaaacaaaaaactccacggtcaaagttggctgaattaaaagctgattttcaagcccctgcttcttcttgctgtctttagtagcatatgaaggaatctagagaggaattctagtgactcaggcccctaaaaaaacacagaaaaaagtgccatccaccccctttctgggatcttctgtcttcccgtggagtctgaggagtcgtggacaggtagcttcctctcaggcctaaagctcggctttcttttgcattgcatgacctgatctctttggcttctagggtaccagggatcactttgtactgtgagagaaccacctttgtgtgttcgtattcagggcaacttgaagctatgctcctgggtgtccattctcaaccattgtgcttgaataaacttttaaaaccagattctgacctttttgattattttaggctgatacctctgaagacgtgcactgccctgcaagacatacattattattggggcaactttgttagtcctcttcatcccagtcgggagagccccttcgggaccactggcccccaagctactgtagccatgtccttgccgccctgatccccgcaccctgcgaagcttctctcaagcccatctaccagagcatgtacctcaggactgctgctacccaaccactcaggtgccctgtgggcctgggaattctctttcggttttgcagcttcaatggctaagcgctcttgagttttcctgaagtttctgtctggtgtttatgctcctcactcagccctggaaggtaaggggctggactccttccccgggaccttcctgtatccacactccgaatgtccctcaggatccctcatcacacttacaggatgcacgctgcctttcgggtggaaaatggctctgatctttatacacatttcccactctgaaggtggagtttccccattccccagggggatgtgtaactctctgcactttcctgctgggagttaaacactgcttctgtcgtttcccctcctcctgcccaaccttcttccccaggaagtttacttccacaagcaccttcatcttctgttctagggggattttggagcatttggggccctcgggtgatggattggaaagtcttgaggcacaggctgagtcaactaaaaccagtggattgtcagacaacaggccaggcatcctccccaacagcagctagaagtgggtctctgccagccggttccttcactcctttcaaacacggggctgcctgaccctggctctgcgctctctcaatcttttgctttcctctagaacagacctcttcctcccatcctcctcctgtaccagtgctaggagcagcaaacctgctctgtgaatctgcatctgaatcttcttacctggccttgaggcttgtggcttctgggccgaataccaagtatttgccaacactcaggggccctcgggttacaagtgaaggactttggggcagcgtgggattgaagagctgagcggggaaattcactgacaaaagctttgaaaacctgattctaaagcatccaaacactataaaatgtgcccggaggctgcagtgtaggtgcagcatagagaaaggcagaaggtcatcaggaggctggagctgatggggacctggcctgggggcggctttggagtctggaaagatcagaactataatgaattgttttggatgcggagactctggtgtcctgtgtgtgctctaagttaaggaccttattcatcatttcaaggacctcggagactagttctgcatatttgtgggatttataaatcctgtttcagtctgtacacctttttcgacctttcagggtcatcggcttttgtttttgttctgccaaggactagccaggccacagaaatcttgatgaatggcaacagcaaggcaaagaaagcagctgtcttctatcgacacacccaggatccaccttgtctcctgaacagtcatccccacggggagacccccagaaggggttccacttacaaatgattaaacagttaatgacacctgggagtgtgcatttgctattcatttgtaaaatgggtctgatttctctcctagcctaaagctggcaagttccagtgatgggaacccctgagcctgattcgccatggcagaggccacacaagctgccttcctcattcaccaaaaaggcgagatttgctggagggacgccaaggtcagtggggggacacactcccggtgccatgtgcctcccgccaagatttcctgtccctttgatggcaaatctgcccccgtcgtgtgaacaatcacaccatctgcatggagtctgtgggacagaaaatgtacagcaataatccatatataatgagtcccccttcactgcccccagcctttgcaacttccgtgaccacaattcctatagtacactcttgggaaacaggaaatccttgtaagagctgcacagtaatcacactggagctatttcacaaactcaagaactgaattgcttaacagcaaagcacagcttttttttttttaaggtgcaaaatcaaacgcagagcccaggggcagttagaaacagctgcctttcagggaccattttctggagtagcagcctgtaaccaaagacttttttttaacctaatgagattgatacttccatgagagtgtctataggcctggcatggtgggaagacgttgttcctgcttgtttggcaacagttattttttaggacagttggcaggaccgacttaaacagacctgtcagaaaaatgtatcataaaatcaaagggcaccctcttgctgctcaaatggttttctcacaaagataacgagggtggtggagtgacttatggatatggtgagatgatgtcaagtgatgctaagtgcaggtagccacagaagcatccaggtccgaggttcccaaaccttttggtttcagcaccactttgcactcttaaaatcaaagagattttttaaaatgtgagttgtatctgttgatatttaccatagtcaagattataatggagaaaatataaacacacaggaatactcaagcctgtgtgccattagcggagaggtgacatcattacacatcagattgcctctgggaaacaacactgctcacatacgtgcaaatgacagtgaagaaagcgaaaggtgtcttgcagtattataaaaatagctttgacctcacagatgctttgaaagggtcccatggcccctgagggtccccagagcacactttcctatgtcagtcagcatccagcactccaggctgggcaacatagtgaaatgccatctctgaaagaaaaaaaaaattagctgggcgtggtggcacacaactgtaatttcagctacttgggaggctgaggtgagaggataccttgagccaaggagtttgaggctgcagtgagctatgattgcaccacagccttccagcctgggtgacagactgagactctctctaaaaaataataatagtaacttttaaaaatatattttaaaaactcaaacatctagcacatgaatgttgttacatgcttggccttgtactaggtcctggggaagacacacaaaataatatgatgtagggaccaaaaagaatataaaatgtagcccctgcctttgagcacactgaaataaatgcaaaaaatggaaaactgcctagtgatgcaagctggtatacagtaagtgccaaatgagagtcagagctaaggtgtatccctggcatttggaatagcagtccctagggcctaagtggggcaagccaggtgtcttggagaaggacagttttgtgctgggcttgaaggaaagatagttggtttatgggaaagaatggaattggcatcagaaactaggattcccctgggtcccagttctgtcattaatcaaacgtgtgaactggagcccattatgacttccccgggtgcaaaagcagctgtgacatttccaggttgctgatcctagcttgagttcacccctctccctggcagacggcttgctgtctctttgctcactcatggtccaatgtgtacctccccagggccctgcatacctccccaagagtggcatgtcccacccttgaactcaatgccgcggccattagcactggataagcacaaactcctgacagatacacacttcccattgtttccacactgagtggtcctctctgtaaaggcctttgatgtcttgcggacctggatctcagtccaggcccctctacttccttgttctataaccttaggcaagttgcttagctgcttggaacctcaatttgtttatgtgtgaaattaagggaataataccttacagcgttgtggggagagttgattgtcaatctctcaatccaagacacagtccaaagtggggactttcaagttagagctgcaattcatcatccatctctggtaggctgtacatacaacatagttgcaagcaacacaagttatgaaatataatattggattaactgatttatttgtttcaaattttaaatcaccacagaactgggtcatcatggaaagataaaaaagaaatagaaaaacaaatactactgatcctactaaacctccccaagaagagaaaataagagaaagagaaaaagactatgagtgctgtaactttacaaggttttagacacttttcgattttcataagtaatcacaaatccttatttatacctttcttgatactgcggaatattacttatgaggactagtaatacccagtatgcaatgatttactcagaagcagaagttggaaagtcacagaagacctatttttgattccaggcccacattcctcgaaccgaactttaccaattgctattttccagaaaagaaacataaaaaggtaggaaggaagggagaatggaagcaaggaagaaaggaggaaggaagggaggaaaaaagaaaaaaaggaaggaaggaagaaagagaaagaaaagaaaaggagaaagttaggaagggagaaaggaaggaaagaaggatggaaaataaagagaagaaaaggagaaaggaaggaaagaaggaaggaaggaaagaaggaagaaaagagaggaggaaggaaggaaaaagggaaggaagaaaagagagaaggaaggaaggaaaaagggaaggaaggaaagagggaaggaaggaaggaaggaaagaagggagtgagtgagggagggagggaaggagggatggagggaaggaaggaaggaaagaaagaaaggaagagaaactgccctgtatggcccttcacctacccctgcaggggtcattaggatactgctacttcatcactttcacaggttaataattactgttgttttctttcccctgagttttatcttatgtgggttgggaaactctagctaagagaagtgatagtttgtgatcttttttgattattaaggaggatgaagcgttttcactttcaatggaatatgtgtatcaaaggcatgtgcatacatacagttaatttgactgagacccagggacgacttgggaggtagttggcgattatttcactattactgagttgtactggtagagttttataacttgcatgccatgatcacacaaatttttccatttagatctcataactacccttggaataaggttttcacttaggatgcctttagccaaaataacagatgacccaattcagagttaataaagagaagctggaaaattttttagcttacataagaattccagaggaagattcctctctgccattctcgccatcagatttgtcctaaggctggtagtatagagctagtcctagctgggcctatctgcttccttgtccaggcccagcttagagagaggccagctttgtgaagcagcattttcttaagagccaggacgctgatttcccagaagccaccagtaatcctctgctcatgtctcatgggcacagaatggcttaggcaggcctgtttctatactaatatggcccaggggatagacatcttgattggcttagactcattagttggggtaaatagatattgagcagtcagctacaatgtcctctacatatgtcattttctagatcagaggttggcaagttgtagcctttgcaccaaatctggccagctgcctgttttgtaaataaaattttattggaacacagccacattcatatgattatgtattgtttatacctgtttttgtgctaggatcacagattgactggttgtgacagagaccatatggttcacaaagcctaacatgtgtattatctgtccctctacagaaagtttgttgaccgttgttcgagatgaagaaagtggagttgaggttaaacaacctgtccagcgtcaaagagctggtaggcagaggctacagtctaagccagaggcccaaagctctctctgctaccagctccactgggagaatttcttgggataggcttgcatgttttgtgatgtgtgccaatgctgccttttacacagagcaacactgacgtaggcctgctgaaattaatatgtccatagtgacgaatttagttcttaggaactgaaattctacatgctaatgtggatagagggataaggaggggcatgagaaaatgaaaaggatattttataatttatcataaaacactggacgctccatttttaaaagacacacaaacatcaactggaataagatttaaaaattttaataagcactggcatgaaattacacattttctttctttctttcttttttttttttgaggcagagtcttactctgtcatccaggctggagtgcagtggtgcaatcttggctcaatgcaacctctgcctcccgggttcaagcgattctcctgcctcagcctcccagtaggtgggattacaggcacacaccaccatgcccggctaatttttgtctttttagtaggggtttcgctatgttgtccaggctggtcttgaactcctgacctcaggtgatctgcccacctcggcctcccaaagtgctgggattataggcataagccaccatgccctgctgaaattacagattttcaacagataacttcacatagattgaaatgttgattcatgtttactttgatgagtttaattcacagaaagtttttaaaatgaagaacatgaaatgaacatagtattcacaaaaaaggacacacctgtaatatctgtttttcctttattatgcagtcaatccctgctccccaagtgtacttcttcagcccctcacctacccctcatctttctgcagtagtttgtctccaaggtggcccaagtccctctagccttctagaattcatacccccatagagtttcctcctacatcatctaagagttggtctatgaccaatagaatatggctggcatgatggcgtgcaatgtcttaaaaggcatcacagagtctaccttggtttcctgacttgcttgctctggggaaattcagtcgccgtgctgtgagggtgctcaggcagccctgtggagagcccccttggagaggcaccaaggccccccaccagcagattcagtaacttgccagccatgtgactgagttcatgggaagcagtcccttcagccctagtcaagccttcagatgatggcaaccttggctcaccaaagatggtgtgagagataataagtgcttattgttatttttagtcgtcatgttttgggggtaatttgttatgctgccataggtaactaatactgacatgcttgcctcgtcacatgatactctttttctttcatttttggtcaaaagtgatggtggaagaaagaggcaggcaggtcagaaggaagttagggatgaaatgaaggacaaaaaaggaggctaaaaagatgtcaaatgaagggaaaagaaggggaaaaaaaagagtcccagatatttcagaatagcacatgttcaattcttctgataacagtaacaataggtagcttttattgagcacttactaggtgcttggcactgtggtggtatctataagcacattttctttaagggatcaagggttctatttttttactaaaaatatgcaccttagagggaggaagtaataaatatgagggataaaagctggacaatagagaacattgcaaataaggctatacagaaaaaaattacatggaactttaaaatttggtaaggaaaggggaaagaaaagatctatgtgtgtattatggatatgaaaaagatattcttcctcttttccttcttttagtcatttttcattcattcaataaatatttgttttaggtactaggatccagcattgagcaaaacacagtaatagagcttgcactctggggccatttcctctttttcagaggatggcatcaccaaatagtcatggtgccagaaacctgagagtcatcctaattcctctttctccccacctctaccatcatcaatgctggggtcctggcaagttcctcttgctgttctctgtcccattgctgctacctctccttcactgggcattcatcatttctccccagctgcacccatttcccacggctgctgcaacaatgtgccacgaactgggtggctttgaacaactgacatttattgtctcacaggtctagaggcggaagtccaaaatcaaggtctgagtagggccatgcttcctctgaaggggaagaatttgctccaggcctctctcctggatcccaggagttccttggcttgtgcaagcccaactccagtcttcacatggcactctccctgtgcacgtgcccgcctcattacgtgatgctctttttatagggacacctgttatgtgggattaaggaccctctctagaatcacctcatctgaactattacatgtgtaacaaccccatttccaaataaggtcacattctgggttactagagattaagacctcaacatcttggggggagtggtcacaattgaacccataccacctgggttatggcacagtctatcagcccacatatcttgaatccctacctctagtaatcccctcactactccccacatctgtccggcacatggtggtcagtgtgatctgcctaaaatgaaaactggatcatgtgattactcagctaaaaagcctctcaagtttcatttatctttagcaaagcacaaagttccttaaaacctgccctgtgcttccctcactagctccatctccctaactgtttcacttttacttgtattttagccacaaagaaccagacacatttcccagaatctgtcacaggccccattccaaggcaagcttcctctcattttcatgctgttttttttaaaactaagttccctaccccgcccccgacctttgccaaacactcccccttacaagactcagcttaaatcatttgctttgggaattcctctcagattcctccagactgagttagaattagaggtgttctctgtttcccttaattatcaacctactcatcacgctgagttataaataatctatttgtctctctttttaaaactgtcagtccctccagggagggattatgcatcccttgtctttgtattcctgtgccttcttgtctttgcatccctagtgccaagtatattattgtcttagtctgtttgtggagctataacagaatacccgagactgggtcatttataaagaacagaaatgtattagcttacagtcctggaggccgtgaagtccaagagcatggtgccagcatcgggtgagggccctcttactgcatcatcccacggcttaaggcagaaaagcaagagagagtgagcgcaaaagattaagaggccaaacttgcagcctctagcccttttataattggtgttattccattcatgagggtgacagcctcatgacctaaacacctctcattaggccccatctcccaacactatcgtattgtggtttaagtttccaacatatgaactttgggagagttcatatgttagcaacttaacatatgaacatagcatgtatcaattaaaaataagtattcagtatatgtttgttgaactcactttactgtcttctctttgaactgtgccttttgcagagtgcaagtagaagagagaaaggtggtggttcgataagccaccttgttcttgtagtttcgtgagagaacttaaactaaatctttcaaatacggatctaatgggttttatttattctgagctctttgactcggctggtatggaactttaaaaataaggaaactgaggcacacaacttgagttagataatggtttgtttaaaaggacaccgtacatttccctgtcttctcacttacacgaggcggtcttggctccccagctggagaacttaagtaatgaatgtctgtaattaatctggggacttttcttgtaaacaccaacctaaaagtgatatttttggtggtattgttcacatcactgccaccaccatcatttccacatgtgcttctcataactgagctccacacagtctccaaatggtaattcaccaaaactttctctttcctcttggctcctgtaaatccccttggttctctttctatgtctctgctccttttctagagaattttctcttaatcataactgtggtgctcttcaagtgtggcaagttgtgctttccaaagatagccacacctggatatttattctgtttcacatgttcttcttatgatgtgagtagccctcccccattgagagctagagtctaggtttcctctttttgaagctgggtagggcttggtgactgtcctgatcacaatggcaaaattggtgtcctgtgatccaagaatgagtcataagaaggatgtagcttccacctcgcttactcttccttctctctccttttgcttgacttggaacccagctaccacagctgaagaaactccggccacatgtggaggctatatgcaggcattccagctaaggtctcagctgacagccagcaccaaccatcaaatgtgcaagtgaaaatctttcagatgataccagtttccatccttcaagtcttaaagctgagggcccagaagtcttaaaacagaaatgagccattccgactggaccctgtctaaattcctgaccccattaattctcactagtgagaattaataaatgatggttgttgtgttacaccactggatttgagggtaatttattacacactgatagacagttaatactaagagcctattttctcttttgttctctccctggcaatttctttcactatgccaatgtcttgttatccttctcatcaccttcctcccaagtcaactctcccatctttgcaagtgcctccccataattacattcaatgcaggcttcctgcctgtgttcagtgttgcattaccagttgtctagtggtcacctctgaatacctagacttgctattgcacaaaaagatacttagcgtcttgctcctcagattcatttctcttctgttttctctgttctctggaaccaatctacctgtctacaagcgttgatcatcattgactctttctttcctgtctgtcctacccaacaggttgctaagtgctgcattgggtcagttggtatgattttggctgcaagaaatacaaaagttagctaatcatggtgtggcattttggggccaatcaggaggtagaaacaggggagtcttaatataaataattactaactatgatgaaggagtaactgtaagatgtaagaaaactctacatagtccctcaggctgacggagaggactcaaggaatgacaagccttcagatctgaaggcattcagatttcatgggaaaaggtttgtttccatttattggatagcagactggccaggctggagctggcctgcactagtatgcaagttggggagcaggtggtcagcacctcatggtatggatgtcctgggaacagcaggagaatctcttctgcagtttgcctccagtgtcctctgctcagaaagcttaatgtcatttagttgaaaggagaactgcttaaatggattcctttatcacagagcatatactagaagatgcattcaaagcagagaggcaatacattaataacacatgcacttggcttaggcatatttatttattctatcacaaaacaaaagatcggatacaagagttttggtgaagtggaccagtgtcattcaggatcctgatgtcttccgtcttgttcccactgtgttggccacattttccctcacagttatgaggggacagcagtttcatatagaaattactgcatccagacaacaaaaaaacacaaaaggggaagggatttctgttttgcaactctttttattggagagaaagcattttgcagaagatctcaggagacttcccatcgagttccatcatcaggactgggtcatacgcccttgctctggctgtaagaatgtctgggaagtgagaatctcacacccacagcctctggtggaggtgggctttgccagcaatcaagggcatgagatgcctgcaggaaggcagccaaccacacctgcctcatgcctctaaccctattcccctctaaattcccatgccaaagccttagggcattatctttgatagttacctggccaggtgttaactaactgggaactgggtgtttttgaaggacacaaggctttctgctgtcgaatttgtcaccttaattgtgatacttttaataaattagcttccagtctatcttaaaaccagatggattttcctgatgtgtcaccgtgaacatctctctttctccaaatctctcaatgaggaggcagttgatgagttaactgcatgggctttggtcccagatcatacagctcacatccaagcgctgtcacttaccaactgcatgaccttgggcaaggtatataatttctttatgactgaattgctcatcttttcaaggagggtaataaaattacctatttggtgggattggtattaacagtaaatgatataatacaggaatggtattgacagtgagccttcagtatgtattattgtatctgctgttattgttccctacttcatatccagccaaatctaagcttattagatgaccatttaagatcctctaggagctgggcacaataaaaattttcaaacttatataaaaattgactacgtcctaaactgcgagctccttgagggagggattatattttatgagcccaggatctagcacagtttttggccaaaagtagtttttctttattcccatgtgacttttgcttaagcaaaaggccttgtacagcaaatacagcttctgtattttaccatggccttgcacttgctgttctttgtgcctacaatgtcctttccctaaatttcccccattcttccagattcactcaaaagcaatctctttcatgatgagatctctttcccaattctcattttgaaaaatgtcaaacctatagaaaagttgaaagaatagtacaagagcactgatatattcttcactacatttgtgactgttaatatttttaacctctgcttgctattcatacatatattctttttttcccctgaaatcatttgaaagttgccaacatcatgacacttcactttcagcatgtatcacataagaacaagcacatcgtcctatgtaatcacagtagctttatcttatgaaatttaacattgattcaatattatttactgtacattttttcttggcagtttatgatcttagaaatcaagaagcctaaaatgaatcactgtgtgttttgagggtcttttggtagaatcatgttcctttctgggtgttctaaaaagttcctggatctttggggtgagattctgtttgagtttcagaacaatgtgtgcatgccatcagtttgatagctcatggtttgtgttccaaaggggcagctattagtgttacctgtccctgctattgctcttgacatcatgcagggacatcctcagtagctgctctttctgcccttggtctgtcatttgagcttgtgtttccaaagtcagatgcaggaagattgggtcctcacaacagggcggtggttggagcacctggatgccaagcctggatctgtcctatcatttgagggacatttgtgttcttggctatttgtgttcttaggctgccataacaaagtacctctgggtggcttaaaatgacagaaattgtctcacacagttctggaggccggaagtccaaaaccaaggcattggcagggtcacgctccctctgaaggctctaggggagaatctgttccatgcctttgtcccagcttctggtgttgctggcaatccttggtgttccttggcttgtagatgcatagcacctccattctcatatggctgccttctccttgtgtgtttcttgcccacttcttgaaagtacaccagtcatactggattaagaacccaccctactctagtataacctcatcataatttatccataaggaatgaccctattttcaaataaggtcacacttgaagtactgggggttatgagttcaacgtattcttttaggggacacaattcagcctataacagggggtcttaggctgatatctgtgagtctctgcttcctcaaaggtttttcagaaaatttaaatgaaatacaggagaattatgccctgcagtatttgactttacagcaggagtcccccaaccctccgggccatggacttgtactggtctgtggcctgttaggaacctggccgcacagcaggagaacgagggcattaccgctgagctccgcctcctgtcagataagtggtggtgcaaaccctattgtgcatgagaggggtctagggtggactgtccttgtgatgcctgatgaaacatcccccacaacagccctccaccatccatggaaaaattgtcttccacgaaattggtgcctggtgccaaaaggttggggactgctgctttaaagtcccttatataggatttacattaaaaattttccagtggtctccaaatgtcccttataccttcctatttttgggtctaggctccaagtaagaatcacgcattgcattttgtcatgcctttttagtctcctttaatttaggacaatggttctcaaacttccatgtgtatgagaatctcctggagagcttgctagagcaatctcctggtgccaaacttccacgtttatgagaatctcctggagagcttgctagagcaatctcctggtgccaaacttccacgtgtatgagaatctcctggagagcttgctagagcaatctcccggtgccaaacttccatgtgtatgagaatctcctggagagcttgctagagcaatctcctggtgcccatctccagagattttcattcaataggttgaggcaggacccatgaaatggcatttctaacaagctggtaggtgacacaaaagttgcttgtctaaggaccgcacttttgaaaaccactgatctagaacagaggttggcaagctttttctgcggagggccatatggtaaaatatgttagcattttcaggtcatacagtctctgttgcaacgactcaactgtgtcattgcaggcaaaagcagccctagataatacataaacacatgggtgtggccgtattcccacaaaactttatttacaaaacagctgccttaccacatttgacccacaggttattgcttgctacatggatttagagtagcacttccactttttttctctttttttttttggaggagagttgttttttcagcgcattaatattttgcaatagtccagttcagttttcttgtcatatgtttcacagtttgaatttgattgttttatctcaattagattaagttgaacttcttggcaagactacttgtgatagtgtgtacggtagggaataactgtgaaagactttgaaatggaccaaaaatattagtggtcaactgtaatggaatgctagctgtttagtacagtcttttgggttatctgattctatggggtcttgtgtctgccactgtctttgaggtattttacaactctgtaaattgtagactactgatggtaatatacacgatttttgtctttagaaatgcaaattgtgtctattgcgtacgcagctgttttttgacctatggttactgaccaattttccatctatagacaaccttatttcagcattcctaactgcttgaatatttgttggattctccttggattttcctttgaaccagctgtgacatgttaccggttctcacattaatgaatgagctaaggaatacctttgatacatgttcattctacatctgagtcatgattataccatcttttaaatattaccctttagcattttttattgcatcactttagaaagcagaaaatgctagttttttaaaaattggtgatactagttttaattacttgattaaggtggttctaccagatctttccattgtgaagaggtattttgtgttttttaaggaagtatactttgaaggtgatactttgagacaaagagaatattccgcttcacaataatttttcaccagatggttttagtatttactgatggtctttgcctgtatccattataacactggagttgcaaaacacaaaccctttttctttttttttttttttgagatggaatctcgctctgtttcccaggctggagtgcagtggcacgatctctgctcactgcaacctctgcctcctgggttcaagcgattctcctgcctcagcctcccgagtagctgggactacaggcgtgtgccaccacgcccggttaattttttgtatttttagtagagatgggatttcactgtgttagccaggatggtctcgatctcctgaccttgtgatccgcccgccttggcctcccaaagtgctgggtttacagtcgcgagccaccgcgcccggtcaccacaaaccctttttcgacgtccacagtttacacctgagctctccctttgacccactacaacactttcttttcttgggcaatatattaatagcacggtggttatgtcacaggcctgtgactggcttgggctcaaacccgggctttttcacttactagctgcaagactaactagttatttaatttctccattcctcactttccttatctgcaaaacggatgcaataaaggcaccccctcttacaggactgttaggattaaatgagctaaatcacagtgtccgaacacttcagtacttcgtacataattacttgctcaagaaatgttagctattattgggtcatgattatttatatgtgtttgaattccagctttgccacatcccagagtgtctttgagtaagtcactgagtatccttgtgcctcaattcctcatctataagtaggttcccatctcataggtttttaaagattcatgcttacatgcttagcagtgtctggtatggaataagcactaaaaaagatgagcttttatgatgatgatgattactattttcagtcatgattattttgtatatttactctaaaagaaagtgaatttttttagttcaagacttttagattcatcgttctactttcattgtggctagctcatggccatccacgtagtgaattaataaagctttgttgagtggcacttgcttgacagcgacacttttgtccactctttcaccttgctggatttgtgctgccttccttgctgtaggaagcccacgcttgggaaataacattcccacagaaggtctgagaggctctgacgggccaaggttgtaaacccccatgatttgactccacgggcagttaaagtgtgttcccaccccccacggatccgctgccactaggctgtgcgaaggcatttacctccctggcactttgatccaagttccctattttcccctactggtcgatcgaggttgggaacagttgctctaacctgggaagcacccgccacgatccagcagggcgcggtgggaggggaaactgaggcccggctaggcacccccgccgcgcccagcccgccgagaggctcaggccccgggaggcacctggagcctgcgccccgcccgcgccgcttcctgtcccgcgcgctgcgctcacgtgacccgggcctgggaggagccggggcgggcgggggtcacctgaacaagggagtcacgtgagcggggggcgggggtgggggggcggtgccgggcggctgtcacgtgacgcggttccggggccgccgctgccgctgtcgctgtcgccgagcccagtcgagccgcgctcacctcgggctcccgctccgtctccacctccgcctttgccctggcggcgcgaccccgtcccgggcgcggcccccagcagtcgcgcgccgttagcctcgcgcccgccgcgcagtccgggcccggcgcgatgggggccgccgccggccggagcccccacctggggcccgcgcccgcccgccgcccgcagcgctctctgctcctgctgcagctgctgctgctcgtcgctgccccggggtccacgcaggcccaggccgccccgttccccgagctgtgcaggtgggtggcccgcccggacgcaggctccgctcgcggtgcccggggtgagcggccggcgtggggggcggggagcgctcgaggagctcctggggtctccaagtcgcctccgttccgcgccggggtccgccccgttcccgagggaaagttgcctgcgtggtgtccgcgagtcccgccgggtcccgtgcgcaggcggggggcgcgggggcacacgcggtcgtggcggtcctggagccccgcgtccggccacttgtggctgtcgctgagtcgggggtggctttgtgcggagcggtcgccccggcccttggggtcggcgcctgccctcgcgcggccgggcgtccgggaaagttggaggcaggaactccagtttgctttgttcccgctgcgcgtttgcatcagagtttcgccagcggggcaccggtgaggcccctcggtgtggagaggctcaccggggcgttggagcccgcaggaatggtcctggagttgagtgtttgtggtttcatttgctgattgatttccccccgtgggctcattttctctttaaagaatatatatatatatatatttttagcaggcggtgacttttgtcttctttagattgggggcagggggtgtcgtccagtgtgagctttcaagacttgacccttcacttctctgagcccaacttcctgcctggttgctcacatgatgtcattgtctccggggcggattattctagtggatcttgctctgggaaccatgattgtataacccatcagtcccatcgagggctgttcacctcgcgcaactgctagcagtccagggcctggggaacttcgaatttcaggaattttctgaccatccttttctggactgtttaggatgatggaaaattcagcttttgtttatttttttaaactttggtaaaaaggaagcaggatgaaaagttttgaacagacaacagtttctccctgttactgttacttttacaagttacttttacaagttacttttcagagtgaaacaaagttgagcctactttgggctgaacttggagtttgtggtagggtttatggggggggttcttatttttcccatgcatcagagatagttttattagcacccctgtgttcagaacatgcagaaattagtctaaggagggtgaggctgatctcacgatagaaactctttggaaaggcccatattttttatgctcccttttttggaaggggaagggtggatggagggagagtttgtgacactagtttaaagaccagttagctaccctaagatacatagttactccagtaactagtatgatacagagaaatggtggcagcttaaacgaggtcaggctgagaacaacatttagaggaaggcattttggaataatggcttctgtgaccaaaaataagaaattaactcgcctgggcgcggtggctcatgcccggaatccagcactttggaaggccgaggtgggcgggtcacttgagtccaggagttggaggccagcttcagcaacatggcgaaaccccgtctctacaaaaaatatgaaaattagagccgggcgcggtggcacactcctgtcctcccagttaagggaggctgaggtggtaggataacgttagccccgcaggtcgaggttgcagtgagttgtgatcgagtcgagttgcactctagtctgggcgacagagcaaggccctgtctcaaaaataaataaataaatacaataagaaattaacccagctggcctagtgtggttgaagtcttggtcttgttaacaaattgaagtttgttttcttcacagttaagattaaggtggcttcaagggcagactgatactttggctgattgatgggacccttacttttgcattaggttagtcatggcagtgtcttgaacctgtgttcacgaacttcatctccaggtggaacacggcctcttggtctagtaggaatggcctttgtatctttacgtttttctggccactgtcacacgtgggcatacttagcaaatgctgaagaggtttctgaggttgatatgcattgtgaatataataagatctgccctttgtagtcttagaatatcttaaaagttgtgtttaatttttctgccagattttcttaggatgacaaatctgccaatcatttcagagacggattttcacccacctctttccctgttacttccctgtagttgcacatgcagacttctccagaaccacttgcaatctctactttaaacccaacatgtgccaagtgaacttcctgtctgttcctgttttataattttttgaggcagggtctcaccgcgttgcccaggcagaagtgcagtggtgcagtcatagctcactacagtcgtgaactcctgggctcaggcagtccttccacctcacccttctgtgtagctgggattacaggtgtgtgccaccccacttggcttattatatattttttaaaatttttaatagagatgacgtcttgctatgttgcccaggctggcctcaagctcctatcctcaagtaatcttcctgcgtcagcctcccaaagtgttgggattacaggcatgaggcaccatgctgggtttatgttcctgttttaaactgatacctctccttaaatactttttgaaaacttttcttggggcgggggaggttatcagtcatctgtacttttatgagataaaactggctaaaatttccgtaaatgtagcatgtagttgaggaataggaatgtaagttgattttttttttaatttgatacaaaaaattttatcgtgtcaccaaggtgtgacgtgttaagctccattttaattttgttcctgggcatcagtttgctgaaatgtaaataactcggccaggtctccactgtgagcatgaaaagtcgagtcctacaaatgtccccgtttgtttttgctgcttggtcacatggaggcagtcccaaatgtacagaaggatcacattccaaatgtttgtaaattggtaatttcatacgtggaatgtgtttttccattgatagtattcttgttcattgtatggcccccagaaagtcattatccttgcaaaggttttggagcacccagacaccatatggctttaacagaatcctagccgtaaattctcattgtctctaaaagatggagttggatttccaggaaaactacctctcctcccaagcccagctctctagaacctagagagaatatttttcatctgcagtcgcttagacccacaagagggacatgagggcctgcttcaggggtgcctgcgaggcaccttgtgggggcaaagcttcaaggtgacctttggctctgagcactcctgggatggggtgcggttcctggtgcagttagttattgggaggaacgaaggagacagcaccatttcagcagcagctttaactgtgtccgtgcacgtggaggggcctgccctctgagttgtgcattgaacagcaggcacgacaaaggctcatttcccaaagtgtatctggcttgaagcagcgctttaaataagtgcatggttttttttggagagactcagcaaagcatttttcaagtgtcaagtggattacttgccaggtggtcccagtgctgagttagaagttaatgattcttatgcaggtatttcttgggaggtgatattgctagtacaaagttagtagaaaacttgtttctgaggctagtgtgataggctgtgggactggcctgtagaaaagacctggggcaggaaggagtgttgaaggtcagtggagggcgggaatagtagagcaagaagagagggcattcaggaggagaggagcagaggccaggccatgcaaaaccaacaacagtgtctaaagtgatctcagcttgtcagtggctttacttattaccatatgctttaaactttgtaaaatgtcatattatatatgtaatatgcaagtttccaccctttagttaggtgttaacaagatgcttaatgggtgaggtcttagcagtgtgcattaatgataaaataatgctttgggatggttagatttaaggtagttaagagcttcaaaatttgtacaggacaagttttccccaaattgtttaggtataaatgctagaaagtttttattatattgaggacaagagaataatgaagccagctgggagttgaggttggtttagttactgtctctaaggagatttttttttccctgtaatttttccaaaggaacagtgcttatatgcctaatttgggccacatgttaaacctggatcacatccatttgtgtgtgtgcatttcaacagtaagtgtatgtggaagcctaaggttgttaattatggttacattagatctcatggattaattctcagaacagcatcctgacagattcccaggaaatgaatgcctgcgttgggcctcacgtcttttgtcagcatttcatagagagagggatttttaaaagatggggctgagagaaataattgagatgttcccttccctattttgatcttggtatataaactattgtattggggaaagaactgagcaggctctagaactgagcctagtggcagagagtagcttatcactttgcaggtgctgttctttttcttcctccttttcttctttggattgtcctagccacagagagctcttgctaatgttgtaactggtcatgaatggtgtatgaggaggtgggcgtagcagctgtttgacttcatgggacccaccagactgtaatgccgaattacaattttgcatttccaccagtgatgtatgagagttccagttctatatccttgtcaacacctgtcagtgttaggtttagccattcaagtggagttgtaatggtatctcagtgtggtttcagctttcatctctctgctgactcatgatgttgagcaagaaaggaacatcttttcttgtatttattggaatcctggatgatgttcaccattatcatgtgcttactgactgggtattttttgtagtgtcctttaaaaatcatattttgtcccttttaccccttaaaaattgtttttgggttcttctccttattgagctttaggagctcctcatgtcttctgggtacaagttctttcttagatatgtgtgaggtatgagtgttttctttcagtctttgccttgcctttaaattttctcagtgatatcctttgaagaacagatttaaaaaaatttgatggactataactttttatggtttgtgcttttggtagcttgagaaatcaaccttaaaactagtgacatttgacctgggtaattttttgtttggagggctatcctgggcattgtaggatgtcagccagcattcctggcctctactcactagatgctaagactatactctaccactccccctcccccagtggtaacaaataaaaatgtctccaggcatatcaaaggccctggaggggagggggcaaaatcacatccaattgagaaccactggcctaccccaaggtctcaaagattttctcctgtctctgcctctagaagttttttggttttaactttgattccttaactctaggatcaatttttgtggtttaatttttatatatgatgtttgaagaaaactcaaaccatatttttcctttgctctcattccatgaacagtcatcaacacagaagacctccgtaatcaaatgtgtggtcgtttttccccaggcaccaagcagtgacccctggccaattcaattcctgaccctgtctacctggagatagtgtcagatgccacaggtttggggctcagttcccgagaccgctccccaccccacaccagtcacaagtccgggcctctggaacttctgaccaactggcttcaatttggggttcccagagtgcctctttgggtctgattaatttgctagagtgacttacagaactcaggaaaacactgatgattagcagtttatgaggatattacaagggatacggatgaagagatgtttagggcgaggtattggggaaggggtgcggagcctctgtgacctccctggctcactaccctccaggaattgccgtgcattcaactatttggaagctcccccaacccagtttttatggaagcttcaggaggtcagcatttcttctcccgggtatagggtgggaccctcactggggaggatcttaagacccacagtccaaaagcagggaagatgagagtcctaccttggggcaggtggaaggaggggcaggtggagagattgtttcctgaggcctgacacacccaacattataacaaaagaccaatactaggactgtggaagttggcagccagaaaccagatgggaaaaaaaaacccatacatgtattatatatatttatatatatatatatataaagtatatgtattgtgtatatattatataagcatatttattatatatatattatagtgtatattatatatgtattatatataatatataatatatagttatatataatatatacacacgcacatatataaataacaccacaaaaagggtaaaagtttatttatttccatgaatatatctagttctgtttactaatactttatgaaatatgcttacagctctgtttttaagtgagattgggctacagtttttttgctctgctgttcttgatggattttgttattaataatatgtttgctttgtggaaggagctagttagcttttagtatttttgtatgtggtgaaacagtttgtatataagatggacattttctgtttcttaaagtttggtagaattcaccagtaaaactatctggccctggcaggctcttaggtggaatatcatcggggaggacttttgattatggttttttctagttttattttcagttttatctagtttatttttctattcagattttctactttttcttgggccaattttggtaatctctattttcctagaaaattgtcattttaattgtgtattcatatttaataagtagcatgctactctcatatttttgatactctatagctctaggtaaatttttaaaattcctgatgtttacttgtgtacttttttcttaattatatttactaaagacttatttacctttttaaagtctttccaaaagaactagtgttttgttttttcatcttttcaccttttatttgcaattttattaatttatccactcagtaacttctacatcatttttctgtttctcgtttgacttgaatgcttagctcttttattttaaatcattttgcataattaagaaatatatttaaagcttcatgtttctttcttcggagtaccataccactcatagattctgatacttttttttttctccatatttcaattttgtgtattccctttttggattcaaaagttctatctgtttcaacttcctggacccactaaatttttagatttttatttttttcaggtccatggactttgggggttttaaatttattttttccattgtgcgggtaaatgtggtggaacttactgacatttcccttgtggcctaacacctagtcaagttgggagggtattatgtgtttggaaaaaaagttctctgtttgggtcaaagttactcatggtgctgttcagcttttctttgccctaactcttcttcggtttgtctgttgcttttattatttgtatctggctgccgctgtggacaggcatgtagctggatgtcgtttgctgctgtcgcccagcttaccagttctcccatggttcagatgttcttctgcttccctgttgtcttttgttgcagaatctcagctgatgtgtagtcacagctgcctgttctttctgcgtggacgctgtagcttctgtcaaccctctgaagatctctcttaaagttctgctctgattgctctattaattatttttccttgggcccagtttctttggtttgagtttgtcaccatgattgcatggtgctggtgcccttgcagtgacaggtgactcctgaccgtgcactctgcagtgggtctccacccgaccttggctgcctccttgtgcagctgcgtggggtagggctgggagcagttgttggaatttggctgtaaattgttttcagggagactaggggatgggcaggatgtgcctctgtggctgttcttggcgctttaggtcctttccaccctcccaatgtcacccccaagcgctgttctgccaagacacagctgctaaacccctgttgattgctgctggcagcgtgtggcctgagacgggggatctggattgttgagttggctgtgtccaatcacttcttttctctggacctcattttcctcctcaagaggggtgggacttagttttctttctctctttcctatttgaaaacctctcattagggagttagttttggaagtcactttcctgggcttgaatccagactcctcccctcacaggccttgggcaagtcacagaacctctgaagtcttcctttccgtgtgtgtccagtcaggatgctaaccatgtttgtaggctaggcgtgggatgctaaccgtgttgtaggctaggcgtgggatgctaaccgtgttgtaggctaggcgtgggatgctaaccgtgttgtaggctaggcgtgggatgctaaccgtgttgtaggctaggtgtgggaattggaagacatttgaatgcctggcacgtcctcggtgttcattggtgctgtagtggtagcagttgctttatctgtaagttacagatgctgccttacatcagggatttatttttataacctgtttctcgccctcccagagctctccattagtgtcttggggtttctgcctcaaccagagagcatttcttcttcatctgtttcatgattggcactccacgtaagcttcctcatgagaaagaaaggtttccactgtttaaaaaagtttcaaagccactggactccgtgatttccgggtccattttgcatcccaaattctgcagttctgaggtttgcagccttgaggagtccttcctcactcagattcccccaaacaatgaggagcttgataattcgaggtgtggagtttggatgggggccgggggtcaccctcctgcatgtggtggcttggtcccaggctaggctgggagaaagggggctgtcgtggttccagggcaagaagagccgtcctccctgtttccctgtggtaggatcaggaagtctcagctaacttctgcacatggtcaagggggtcctgtcctcacttaggcctctccaggcctccctggagggtggaggaatgggtgctgttgtaggtgggaacagaagtgtccaggccagtggcttggatgtgaaagtgcttcataaattccaccttgctgtgcaacttaaaaaaaaaaagtacggtcgtttaggttttcgaggtgcccaaagcaatgcgtcataagcctatttttgtctccgtgttagccagggcagaggggcactttcctgtgactcctccagggtggggaaaatcccaggtgctctgtgaacctggccgttcagccagctgcagacctttggtaggagttttctttttccttttgtgtgcttttcgatcccctgggggcaaccattattcagtacatctggagggcaagttgtccaggaagaggaagcagatcctaggagtgtcgtccttcactgggagaggtgtaggaagtgagggggatggtggaagtactggcccgagctctgttttcaggagtgtgtgacagcaaaaactggcctttgcagttgagttgcctgtgggctatggcctagagggaaggccaggagggtcttgctgttagggctgccaccttcttcatgcctgctgtgtgctgggaggagagagctccttcagagcggacccaccattggattttgagtgtgtgcaaaattaacttgttgctatctgcatggttatctgtactccagaatcagttatacattttaaaacagctgtttagtactgaaaaaactcccccaacactccctgcgccccaccctggcctgcaaatagagtgccaagccaccagaatagaagtgctaaagtagtgagtttcctagaagtggcaagcctgagactccagtgagtcaccctcattgttcccctgaggcaccctgcctccacctgctctctgctctcgaagcgtcagttataccagcacttctctcttctcttttgtctctttttacagtcacccctttagagtgacaggcagcgtgagctcatggccttgactttgctggacatgcggagggagaggagagctggtggcagagtcgggggttgggccctgaggatggggctgttttattggagagtccgctgtcaccaggcctttctgtaaaaggctggaagtgagcgagtgaaccaggcaccctggtggggggcctgcatgtcagacccagcgggaagcatgtctgacttggttgagaggcagctaagggcccagtgtgtctgggtgggctgagccattgggagaatggagggaggggccagagagcacggaggattagctgtggccagatcacagaggctgtgggactttgggctccctctgggtaaaagccagagcccttgaggacttcagtagattggtggattgaaaggcacatgggccggtgctgtggctcatgcctgtaatcccagcactttgggaggccgaggcgggtggatcacgaggtcaggagatcgagaccacggtgaaaccctgtctctactaaaaatacaaaaaatcttagatgggcgcggtggcgggcgcctgtagtcccagctactcgggaggctgtggcaggagaatggtgtgaacccgggaggcggagcttgcagtgagctgagatcgcaccgctgcactccagcctgggcaacacagtgagactccgtctcaaaaaagaaagaaagaaagaaagaaagaaagaaagaaagaaagaaagaaagaaagaaaggtacatggaagattcgattgcttggattgccttagggaactatgagatccctaggtgagggttgcagttgagcatggtagctgcttttcctcttcaggttgcctttaggctgcgatggagatagcatgagctctggagcaggacaggcttctttctaacatgggcttggccactttgtgaatttgtgatcagagacaaggtcacggacctcactgggacctccctaggctgtccattctgagtctgtaagaaggtggagaggggcagccccagctgggtgttaggctttgcggagcctctgctgtctgatgtttggctccagcatcttcaaagcaggggcttttctcctctgtccacctgattggcctttgtgaggaaccaccacctggcggtggcctcattagcatcatgggccagccagctgagctgacagcccgcaggttttctagaaaggcccaccttcccttgtagtttgcacactccaggaagggccctgggtctgggagggttttctgggaccttggtgacagggagagtagggggctgaacattaaggtctgaattctgcgctgggggctggattgtccttaaaggcggttggcctcagacatccacatggcaaagcagggagtttagcccatctacaactcttctttatacatgaggagcaaagtatgagaccgcccaggtaattgctctgattggaagaaaatcatcacggagcagggtttagggttgaaatactggcctgcatcctgtactgttgagttgatctgagccaaggatagcagagaggaccagccatttttgtggtagctttctgttgtggagggcacttgcccacctcctgggaacgccacaccctggtgtgtttgcccttgttctgtttcccctgctgctcttctgctggaagctctggactcacctgtctctgttgtggatggtgcagggcgggcaggccagagtggcatccttgtcctgagaggtcccaggaggcagttgagtgtgtatgtgtgcgtgagtgcgtgtgtgagtgcacgagtgtgtgagtgcaagtgtgtgtgtctgagtgtctgtgagtgcaagtgtgtgtgtctgagtgtgtgtgtgtgagtgtgtttgtctgagtgcgtgtgtctctgtcttcatcagctcctaggagatgcctccggacaggggcctgcccgtctctccctccagttccttgccagtgtcatgtgacactcctttcagagggcaccccccgcccccagccaactcacctttttttgtaaacttagtttttaagcagtccaactctctctctggattcaaatgaaagctttagatcatagtctgtttcgatagctctgtgttcctggtggtggttttctcctcacaatgaccttgtaggctagctgagttttgtcgaggaagttgagctgggagagactggctcacacagcttgttagtcagcgctggggcaggaatctggcccaggcccttcatggcacctttcttagggtagcgtgccccctctctattccaggtgacctctgttacgcagtccccattgcctgccctggttccctgggctctgacatcaacttagatgtcgtgtttgacttagggcttccagccggatccctctccatacaccgggcttccttccagaccctgcatacctctcagggaaaaccaaaggctgacgtttggcatttccctgcttctatttatttgtatttgtcggccctgtatctttgtccacagctttgtgggtttgttagaataggaagtgaagtacttcctatataagctctggccatgctgtgtcaaactcacgtgcttccccagccttcagctcggggtaggagtcttcatgcaaatcagattgtttctcttttagtgtaggcaacagcaagttgttgacgacagtggttaccttaggctcttgacattctgctcccaaggtccagtgtgggaaccctgcctccttgctcctcttccttgctgttttttccctttctccttagttaaggagactggtctggatttctgaaggtgactgtgctggatatgtatgagctgaaacactgtctgatactgttgagggacagtagtgagccaggtgatttcttgaatactctgttagaggacttgcgtgcatgtcgaaagtaggagaatcttttttggatgttcaggttggaaacacttcacattctctttgtctccaacatgttagatttgttgcttgctgtagactcagagaaacatttctctagctagtgaccatgtatcttgttatgtgaatttcacttatgtgtcaccaactgggtttctgtcttttaaggaaaccaaattacagattcacacgtgcctacttttattattactgatcccatcctgcctttatcttgctttattaattgcaggccagtagtaaaatgtttaatagttacatgaccattagcataaccccaagattcacagggactgaggaaactaagatatattttaaaagagtttggatatatggcaataaatgaggaagggacagagtgatacttcatggagatgttttgtgttgaagggaaggaacccagttttctaagatttattttctttaagagattgagcataccatatattttgatcatagaattttacatactttagatgctagctgtttttaaaaggaaagaactccaaattacatcttgcaagctattgtggttttgcaagcattgagtgatggcatatatgaaaactctgagaggtgtcatattaagataccaatgtcagtttaaagatattctatatctgtatccctatgacattgtattttgaattttttatttttcatttttggacagacatttagaactcactcagtggagatggctctgcatctctgttttaagctttttgaactctaggcagctgtgtcggcctggggctacattgacttcttcattgcagcccctcgattggtttcgtctggaccagggtgggtttcgattgcggcccttgctggaacagtagcaggaaagtagaaacaccttcctgtctctgggttaaccagctgacagtctgttacttgtgtgcttccttctaattggtaatctgccaacacctttcaggatattatgaaatttcaagcaaatgaggttaaaatggaacctctgtacttctgaacaggcgtggactgactgcagttctccaggatagtttcagcagaagcagtgagattacagtcaggagcaaaacagtatctgagctttctttatgggaaagattccgactgtgtgcttggtttatatggttaaattaattgcccttgttaaattaaaaaaatagggtatgtttctgccacagactttgctttaaaagcagagatcttctaaagtcatttgccttgtatttgacttctgctgctccccgtttcctgctgggcctgatggtttgattgtagaatgtttctgagttgtgtcactgttggactctgctgagctgagtagtctcattaaaggagagtgtgcatctgagttgaggaagacaatatagatgtggaccttgtttgtagagttcacaagctgcttacatagaaatagcaaggacagtgcagccagtgggaaggagccggctgagggacttgatattatttccatggaaaccagttgggtatgggaagagaggttgtggaaggcaatgctctggtgtttggcaattcacactgtgcagaagagaaagcagaactggactgggagtatagagtagcagaagtttaagcttggggaagaagttgagcaaggaaaagcatatgatctgttgatcagcatgatgtgatgtggtctgaatcttcagacagttcacagctttttcatagaggctgtcctcagatgggttcaaccattctgagaattctgcctttacgatataagtagtatccatgacattaaaaacgagaagagaagcgttttggccaatgacggactgcataaactacagtctgcataaatgaccttggtcctagaagattaggatgaagctgaacaattcttatcacctagtgatgctgtagccattgtaatgtcgtagcacaatgcattagtcacatgtttgtggtaatactgctgtaaacgaacccactgcgctaccagtcttatgaaagcgtccagtcaggtcctaggcctttaggtccactcactcactgactcacccagagccgcttccagtcctgcaggctccattcattataagtgccctaggcaagtgtgccattttaatcctttataccatatctttgctgcaccttttctacgtttagatatgtgtcacatgttacagttgcctggggtattcagtgcagcgtcatgctgtgtgggtttgtagcctgggaacaataggacataccatatagcctaggtttgtagtaggcgacaccatctatgtgtgtgcagatacactcgatgatgtttgagcagtgacagaattgcctcatgacacatttctgatgacgtatcgccattaagtgagtgactataaaccagtccccccatcagcagttacacttcctgaggtttcagttacccatggtcacttgcagtctgaaaatatgaagatattttgagagagagatgccacattcacataccttttattacagttataattgtgctattttattattagttgttaatcttttacaactaatttataaattaaacttaatcatgggtatgtatgtaaaggaaaaaccatatccgaaaccgtattcctggttccaggcctctactgggggtcttgtatctgtgattacaaggtgctgcgaagggataactgtaatttttctatatgactagcattttattgaatcaagttgtgtagatggttggcaatataataggaactcagagatctttatgccatacagagtctgtccttttaatggcatttattgtgacaagatttaaactaaagttttgtggaatgttttgccagtttttgtgttgtaactgaaactaaatgttttctgaaaagttaaaaccatttctttaaatggaaaataaatgaagccgtttacctaattggttaaggactcacccgtgggcctcacaccgcctaggttaattcttcactttataattccgtgatgttgggcaagttcctcattctgagccttgggatatttggcttcaaagctgaggaacttgggagggttggataatggcatcacgttctgtggggagatttggctcacatgttagctgtgtgggtgagagccgtgctgtcatgcgttcttagccactggccagtttccttctcaagccatcagtagagatgctgatcctgcatctgccagtcattgctccaggagggaagacattactgtcccagagtgacggtgtcattggggataacagacacttcagaaaatgccaccactgagctgtatgaagtgccatggcagctagtgctggagctgtggattcagccggggagcactgtctggaggagctgctgcagcacatgtgtgtctctccagctgtcaggctggcctttggagtgcatttggattttttgagaatgagagagggaccattggctaactgttttacgctctgaaaaatgacatagaatagcaaagattttacttatttttgctgattttctagaacattttctgtcccagagtgatggttttgaagaaccagcgttcttggaaagatggttttgcatccagaagagtgattttaactaaaatcaggctgcctcccttgaggatggtcactgaattttgtacaactgggacaacggacagggatcctgggttgtttccagtggacaagccgcttctgtgggggcctttgcagttctccccgctcctctcctgtgtcccgctggtttccttcagttgagatggaatacagcatagagtcagtgacttttagaagacttgacagagtttcaggaaaatgctcactgggctttcttacctatcctgctgcagaactttttttttttttttttgagatggagtctcactctgtcacccagtctggagtgcagtggtgcgatctcggctcactgcaacctccacctcctggattcaagctattctcgtgcctcagcctcccgagtagttgggactataagcgtgcgcgaccatgcctggctaatttttgtgtgtgtgtgtgtgtgtgtgtgtgtgttttttttttttttttaagtagattcagggtttcaccatgttggccaggctggtctcgaactcctgacctcaagtgatcctcccaccttggcctcccaaagtgctgtgattacaggcatgtgccactgcgcatggcctgaagttctttctttcagaaaatgtattcaacacattcttttgtgtgtgtttgagtgaagacggtgtttccacacagcttgcagatactttcttccagaagcttgtttgttgctaacatttaacatcttactgttacagcttagttttctctttgattgaatatattgatctctttttttttttttctgttggcttttttcttaagtctttacttgtgtaagctcagataacttagtctagaatgtaggctttttctgggaatctcagctgaatggtttcatttgcttggctgttaaatgaaccatactgtttggaatagtttcctaattctggctgtacatgttcacttcaggtagagaattttctaacagacaaactttcagacaaaaaatttattattcctcaaagatatcattacattttatttagtctgtaataattttattgcttctgaaaccattttctagttctataatgtgatcatggtgcttttaaactttaatatcaagttaattttaagaatgattttagcttaggccattctaggggcttggcctttaatctgaaaagaaatttagaatcctttagtttcaaacatgtgatttcttaaaacttgttgtcagttatttatacgattttcaagtttattatgaaatagtctttaaaaaatatttactttagtggaaacatatctagtgatagtttaaccagggtgcataccagagtacataatagtttttggaatattcttcataaattttcagagagattatttaaaccacatgactgtttctgagctcctgttgatactaggggctaggcatattcgttttttctttttgagacagagtctcgctgtgttgcccaggctggagtgcagtggcacaatctcagctcactgcaacctctacctcccaggttcaagcgatactcctgcctcagcctccctagtagctgggactataggcgtgcaccaccacgcccggctaatttttgtatttttagtagagacggagtttcaccatactggtcaggctgatcttgatctcctgacctcgtgatctgcatgcctcagcctcccaaagtgctgggattacaggcatgaggcaccacgccctgccattagtttgttttaaaggagacataatgtccgttgaaacatcagaatgttttaagtactgacagcttgcaggtgtctttggagtgaagtttagaaacctgctgtgaccattcttcattttaaagctgtgactaagaactctgagatattggtgccttcgcctcaagtgctgctgatgggtttgaatggcattgaggttgccaggcctggaggagggctgccttgtgctgagtggttaaatcacccccctgaaaaaagtcagtgtttcaagtattttaataggctcctcctttcctactcccataaccacttacatttgataaatcttgacaaaacaagtatgaaatccaagtagagaaaataatataattgaatagagcaacacttttctttctagcaaccctgatttccagattatcaggacaatatccctcattttattcttttttaaatcttgattctgctccccaagcaaacacactctttaccttatttagatatcccctttgcaagaatggtggatttcttttaagaaaagcatagcaggccgggcgcggtggctcacgcctgtaatcccagcactttgggaagctgaggcaggcggatcacgagatcaggagattaagaccatcctggctaacatggtgaaaccctatctctactaaaaatacaaaacattagctgggtgtggtggtgggtgcctgtagtgccagctacgggaggctgaggcaggagaatggcgtgaacccgggaggtggagcttgcaatgagcggagattgcgccactgcactccagcctgggcgacagagtgagactccgtctcaaaaaaaaaaaaaaaaaaaaaaaagaaaagcatagcattttaggtacgtgtggatctctttagcgttgattcctaccagttaactcattttaaatgacaccctcatgcaccaatatcatatacttaggattgtgaaatagtttaatgatgccactgccgctacttgaagtttgtctctgttatcctggagaaactagtcatggctcctgaataagagattagcatttttcctgagtagtagccaagtctttgtttacttgtttatcttgtatcctgcaacctggaatatacactccgagagggcagggcgtctttgttttgttcattgctgtactctcctgtgcctcccgcagtaagtacttaagaaatacttgtgaaacacatgaataaaggttaacgaagggcaaaggaaacaagcctttattgatgatttttctctgtgcccagtaatacttgggttattttctcatgtccttgagtcatcttgactctaggagacacctcttaacatgttcctgctgaaaaagctgagctgaggagtcataccccgagggtatcaccctaagattgggcacctgagtaccccagcctgctcttcaggtctgtagctgcttagtggctatcagaccttccaagtctccatgcttttgaaggcctatgtgtgcggtttggtttcttggcaggggggtttgatgggttcccagacctaggagttcttggcgcctcgtcttccagtgaccccaccagggctgctctttctcctccattgctgaaactagttcagggttggggaggagggcacgtgggggggcctggtggttggttttgtgctgagtcattgccttggtgcactgtggaaggaagctctgggaggtggacggctccttctgtgagggagtgcttctgtcgtcaagggagtactgcatagggtgaataacacagttatgtagatatatatggtggtcttacccccagggcctccacaactcctggatgggcctagcctaagcaattctgatttaacttattgcccctccttttagcaatactgttgagttaaataacagtttttgcattgaaaataaaaaaattttatttttgtagagatgggatcttggtatgttgcccaggctggcctgaaactgctggcttcaagtgatcctctggccttcgcctcccaaagtgctgggatacaggcacgagccactggccaggtctttattttttgcattttgcaaggacattttaagtcactttcttccttttctgtttttactcctgctgaggagatgatccccattttacaaaatggacaaaacattctccccagggaagggaagagtagacatttgagaataattgttttcacagaaccgggaaaccacctattttgtcccaagtatactgattgatgcattagcaataactcactatctgctttgccagaggtttgaacaatgagtgttaatgcttggtgtagtgaattttgtgtgatttcgaatctgatagctgactcattgcacagctctgtcttgcgagttcagatctgaactgtagctctaagaggtaaaagcagaagtggagctgcctttcatgccatagctagttttttaataaaatagagttaaaaaatcctttggcttttcagcattttggtgtgattggaaaggctattactatcttatattcagcatgagtcttgagcaattactgattaatatgatttggctgtgtctccacccaaatctcagcttgtagttcccataatccccatgtgttgtgggagggacctggtgggaggcaattgaatcatgggggcggttacccttatgctgttctcgtggtcatgagtgagttctcacgagatctgatggttttataaggggctttttccccttttgctccgcacttctccttgctgaaaaagaatgtgtttgcttccccttctgtcacgattgtaagtttcttgaggcctccctagccatgcttaactatgagtcaattaaacctctttcctttataaattacccagtcttgagtatgtctttattagcagtgtgagaacagactaatacactgatctgagttgatattcttaaattaatggtaagatatttcttttttttttttctttggagacagagtctcgcactgttgaccgagctggagtgcagtggcacgatctcggctcactgcaacctccgtctcccaggttgaagcagttctcctgcctcaccctcctaggtagctgtaattataggcgtgtgccaccacgcccagctaatttttgtatttttagtagagatggggtttcattatgttggccaggctggtcttgaacgcctgacctcgtgatccacccacctcggcctcccaaagtgctgggattacagacgtgagccaccatgcccagccagatacttctattttgataatctttgagtcctgaggtagcttcagaatggattgaaccacagacagatggtgttagtagtttctgccctggcttctttgcaacttaacatacttgactttttagtgtttttggctaaggaaagtgtattttctagtttgtggcagttttaagcaaatgtggcttgaataaaactagagagaagtttaatttttgataaatcagtgacattgacaagttgtttttcttcctttccagttatacatgggaagctgttgataccaaaaataatgtactttataaaatcaacatctgtggaagtgtggatattgtccagtgcgggccatcaagtgctgtttgtatgcacgacttgaagacacgcacttatcattcagtgggtaagtagaactacctgaaattactggattggcaatatgattccccaattttgcaaaaatgactgtgtatagctatacgtatatagcgatacaaaaattttgaatgtttagaaatcataagtgtttataatacataatacacatttgttagtagttaaaaatgctaacggtttgaatgtctagtatgagctaaaactaggttggttctgtctagtggatactatacagacagctgttatgaagaattatgtagatgtgtatttgatattgaaagctgtctcctagatggctctcccttctcacccacacttttcttaaaccctgtttttacattctcccccagcccacatttccttttagtgctcccccgactcccattcctttgtaccttccagctttggctgtagttcccagacagtgtttctgctgtcaaagatggtcactggagttaggcttacattaaaggttaaataaatagtcctgaggattggcagtctcagagaaagaggtgcagccccttctttcctagggttcgtttcattccccaaatgtatgccttttgggtcaggatcgctatccttctgtgaagaatatgaatccaagtggattaatatatcagcaccaggttacatagagtggagtcagggcagatgcctgaaggaagggaggcagggcagacagaaaagcagaatgcattgcccttggatttggcaacatggatgtccgtggtgacctttcactaaggcagttagaataatgaggtttgaccacaatggatgctcgtgacatagagatggtatatgactagggactgtctgataactagaagaagatgctaggtgggcttttggatttgggagagaagcttactgtggtagctctgtcattttcttttgtgttttaaacattttaatatttttatagatttggcagttcaagtgcagtttgttacatggatatattgcatagttgtaaatctgggtttttaatacccgtcacccgaatagtgtacattatacccagtagataatttctaattcctcaccccccaacctttctgagtctccagtgtctgttattccactgtccgtgtccatgtgtacctattatttagtttctacttataagtgagaacatgtggtatttggtgttctctttctgagttattttacttaggataatgtgctattgttcaattcatgttgctgcaaaacatgtgatttcattcttttttatggccaacatgtggaatttgtccatagaaaagaatgaaatcacacacacacacacacacacacacacacacaaacacacaccacattttttgttatccagtcatccattgatggacacttaggtttattccatatctttgcaattatggatagtgctgtgataaacatatgagtgcaggtgtctttctgatgatttttttccttcaagtatatattcagtagtgggattgctggatggaatggtagttctatttttagttccttgatagatctctatactgttttccatagaggacatcctaatttacattcccaccagtgtatgtaagcattcccgtttttctacgttcttgccaacatcttttgctttttgactttttaataattgccattccagtgggtataagatggtgtctcatggttttaatttgcctttctctgatgattagggatgtggaacatttttacatatgcttgttggccatttgtatgtctttagagaaatgtctgttcatgtcctttgccctctttttaaaggggttctttttttctttttgaattgtttgagttccttgtagattctggatgttagtcctttgtcagatgcacagtttgcaaatattttcacccattctgtaggttttctgtttactctgctgtgcagaagctttttagtttaattaaatcttacttggctatttttgttttgttgcatttgcttttgaggttttagttatgaaatctttgtctaggccaatgtccaggagagtgtttcctgggttttgttctagaatattcatagtttcagatcttacatttaagtctccaacttttgtatatggtgagagatagggttctagtttcattcttctgcatgtggctgtccagttttcccagcaccgtttattgaatagggtgtcccttcgccagtgttatgtttttgtcaactttgtcaaagatcagttggttttaagtatgtggccctgactctgggttctctattctgttccattgatctgtgtgcctatttttatatcagtaccatgctgtttgattactatagccttcaggtataatttgaagtcaggtaacatgatgcctccagctttgttctttttgtttaggattgcttttgctattcaggctttggctactcatatggttccatatgaattttaggattgtttttctaattctgtgaaaaatgacattggtactttgataagaattgcactgaatctgcagattgctttgggcattatggtcatgttaacaatactaattcttctaggccatgatttttgcatctgtgttcattagggatattggcctatagttttccttttttgttgtgtccttgccttgctttggtgttagggtgttactggcttcatagaacaagttagggaggattccctccaacttgatttttttttttttttttttttttttcagggagtagtctcagtgggattggtaccagttctttgtacctttggtagaatttggctctcaatctgtctggtcctgtgctttttcttgggagatttttaaagtactgattcaatctcactcctttttactggtcttttcaggatttctgtttcttccgattcaatcttgggaggttgtatgtttccaggaatgtatccatttcctctaggttttctagtttttgagtgtagagatgtttatagtagcctctgatgatcttttgtctttccatagtatcaatgtctactttttcatttctgattgtgcttatttgaattgtgtctcttctttttttggttaatttgagtagtagtccattgattatgttcatcttttcaaagaaccaactttgttttgttgatcctttgcattttttggggggggtctcaatttcgtttagttctgctctgatttttgttatttcttctgttaggtttcaatttggtttgttcttttttttttctagtgccatgagggttacattaggtcattaatttgtgatctttatttttgatgtaggcatttagtgctataaacttccctcttaccgctgctttgctgtatcccagaggttttggtccattgtgtctctatttatattcatttcaaaaaatttttacatttcatcctaactttgtcattgacccaaaggttattcaggagcaggttgtttaatgttcatgtatttgtgtagttttgagagttctcctcttggaattgatttctagttttattccgctgtgatctggaaagatagttgatatgatttcagtttttaaaaatgtactgagactgttctgtggcctaacatatggtctaccctggagactgttccatgtgctaagaggaatgtatgtcctgtggttgttgggtagaatgatctttaaatgtcttttaggtccatttaatcctgagtccaatttaagttcagtgttttattgttgattttctgtgttgatgatctttctagtgcttgtagtgaggtgttgaagtctctcattattattacattgctgtctatctcctcttaggtctagtggtaatgattttatgaatctgagtgctttggtgtggggtgcatttgtatttaggatggttatatcttgttgaattgatcccgttatcattatttaatggtcttttttttttcttttttaactattattgacttaaaagtctcttttatctaaatgttgcttctcccgctcacttttggtttctatttgcatggaatatcttttcctacctatttaccttgagtctttgtttttaccagttaggtggttttctgtaagcaacatatggttggatcatttttttttttaaatctagttcaccaatctatatcttttatgtaaaggatttaattcatttatgttcagagttaatattgatatgtgaggttttgttcctgtcatagtgttaattgttaactagttgctttttagtgtcaattgtataattattttataagatgtgagttttataccttttgtctgactgggttaattcaaacctgtctttaagctattagattctcttttctgctggtctagtctgctgttcaagctttcaactgtattttgtaattcctacaatgaatttttcatttctggaatttctgtctggttttctaaaaaatagctttctctagtaaaattttaatttagatcctatatttttccgatttctttgtgttggttttttgactttctcttggatcttattgcgcttctttaaaatcaatattttgaattccttagctggtatttcaaggatttcattttctttagggtccactgctggagagttagtgtgagtctttggggatgttgcagcgctcttttttttttttttttttttaatacttctagagttgttactctgtttcattctcatctggataaactatctcttctttatttttgaatttactttggcaggatttttttttttcccttgagaatgtgaatataacgtatgttgtatatagttgtttgacttcagttctgggtactttcagtgacagagactctgagtttcttggttatagttggcctttttgtggtagctttctcaaatgctagtgatagtaatgatgtgcttgggtgtgtgagcaggatcctcaccgtctcccgcggggcctggaaggcagagttctcaggaagttattttgttctcccttgctttgcactttggcagcagaatttatattgggttgtgcaggccagcaggtggtatttatgggtaaaaaccagctgcagtggaatccgatgggtgggtctatgagtctctgtgcttgacctttgtttaatgggggaagctctgttgcttcaggcagtggagtggtctgtggaatgcacagtggcctgagctacctgctcagcccctgagtgggggacaaagctggacagaactgaactgccagttcttctcttggatactccagtggctcaagcaccagccctaacaggggtagcaggggtagctgtgtagaaggtgccaaggtgtctgcggggaggtgtgggggttgctccagctccatggcctgggcaggtgggagcacaatctgcctccctgtcacaccccgtcctggcgctgggaatattcagaacatgagaatatcgctgtctgtctcaggctgcagtgtagtgagtgctacgagagacacctgtccatggcttaccaccaatgtgtcttctgtagtgagcctcctccctcaacccaaagcacacacatttgtagctctcctgctctttgccgcaggaatgctgtgggtccgtgtagagagggtgaggccccacctttcgtgcaagtcctggctcagtggaagtcgtgcaagtccactgccagtggaaatgcagcttcccctaacagccacagaatggccactgtcctgtgtgcctgtgccaacctgtgggagcagccatgactgtgcccacagcagtgggtagagggtgggggaggagaagtcctactacccacatccgtgcccaagcactgagaccacctggctcctgggctggaagcatactcctcccttgcagggctgagtacagcacccctgtctccactgcatgtggcacaggccacaagccatgctcctgggcacaggaaagtgcatgctcctttgtcccaaggagtgcccccttggcatgctgtactctttcttcccttaggagcagcactccctgagggtagatctctgggaaccctgcagctcccctgggtccagccagccctgtgtggctgctgcagtctcagcaggtgccaagaaaggtctgcagggcctctggtgatacggagacatcagtgctgagcttccccaggcagtcctcccactgctgccgccactgccacccaggtccagtggagggtgagcaacctggcataagtggtagtctgatgtaatgccctcaggaagtccccaaattgctgcccgcaccagtgtttgggtttgtgagggcagaaaagctctcccacagttcgggtaccagcagtcgaccacagaggtgaggggcagcaacagcattcccgccacccctttcaaaggaataccaagtccctcagggctcctagccgctctctgcccctctcgtttcctgctttttattttttgccctcgtttcatcccaggggttctccaccaggctccagtgctctccacttgatactccattctggcgacggttgctcacctgtaacttgggttcttctgagaaccggcctctggcaactctgttcagctgtcttgaaacaaaagaaacccccacttgtcattttgcatggaaattgctaaacacagttaaaagagctttgtagaaagcagtgtttagagtacgaagataagggagtgcgaggtctgctgattgaggcccagctcctgtttgatttccctctctctctacaaagagaccatccagactgaaaaacctggtgagagggatttgaggcctgggattgagatctgagaaagcactagattgttgtgaattcttgggtctgacattatccttggtgatatacttaggaaacttacaggtgagatggccagtttactcattgtgctcttttgagaactcacagagaaaggccacaagtaattctgttggccagtgttatgtaggtgttcagaaagaaggaaaagtagctttcttcttgattttattataatacttcaatatttttggctaatgaaagtatgtcttgagtttatggtagtatagtatggtatggtatagtgtaataccacatagactgatgccagatggaggcaacttacttgaaggataatttgtgagcttggcctcactggacaaagtttgagtttgaccaagttctgtggaccttgaaagccagggaggagaagagttgttatttttttgtagggagtggatccattacagatcttttgtgatggtaacggggaggtgatgtgatggaaggtgtttttaggaagctggccccgtggaataggaaacgatgcctacaggggagataccaaagataactagatgactaaaaagtaacttacaggttaagatgatgatgatactattataaaccagcagtttccaatctcattttttcccccagatatgtgtgacagatccctttcccagagcttgaaacttccagagggagtcatcatatatactttcaggactctcagtaacggctccctttcttcaactggagagagcagtttgtatgagtcaatgagagtgacattcacagtagcatagggataatcccgaatcaaatctaatttgcatatacaataaaaatacctaaattttgttgcacattcatgtgctaggcctaatgtttaaaagtaaaatatctcatttaattcattcaacaaccctttaaagtaggtgatttcatttccctcatgttataaatgaagaaatggaagcgcaaaatggatctgtgttctacagtgggcaggtctgtgcaaatctgcccccgaagtccaaggaagttgagaggctgaagaaggaggctgacacccagtttctcagaaagaaacatttaatacggacttatgaatagaagccacatctcaagaagtcacgagatgggatggatccctctgccatcacccactccagacccagggatcatacaccatagggaaggggtggttcagaaggaatgtgtaggacaattgaagtaggttttttgacctaaggggaggattcgtgataattacctgctcttacacaaggaacagtagataaactggaaatcttggaggccttcctggaactggggttaatcggaagtcagcagggctgtttggcctccagaatggcgttactttagcctccacaatgagcaccttgctggaggtggtgtggttatggatttgaatgtggacagccggctccagagcctgtgtactcactcagggctgtgcttttgtgtgagtcatggggtcacatcagacagattggagctgaaatggagaccaggatgggagatctgaatgtgtggctctgagaggacatctgagaacgaacttcttttgatcttgttagaaaggaaaaaatgtgaaccttcaaaacaaccacaagaactggagctccccgcagatcagaggaacagaagagctagcatagaaatagatccaaatatgtatgggaacttaagataacttacaaccaaaaaattgggtgtaagtagctattgtctcttacgaaacaaagttcaatccctcctttagatcacatactgaaattacagctcagttaagatttgaaagtaaaaagacaatagaacattggaaaaaaaattagtaacatatagatataatctagaagagccttccttaaggaatcctggaagccatacaggagaagaggaacatttcttattacataccttttaatgactaaaaggtgttctaaagacaaaagacatacactagactgggaaaaacatttccagcatgtttgccaatgtactattaggatgagagcttttcttaaaaattggtaagaaagacagacacccaggagaaaaatggcaaagtcaaagaacaggtaattcacaaaagaagaaatccagatgctcaatacaacttcactaataagccaggtggattagtcctttctcacattgctgtaaagaactacctgatacttggtaatttatgaaggagagaggttggattcacagttctgaaggctgtgtaggaagcatggctggggaggcctcaggaaacttaaaatcatggcagcaggtgaaggggaagcaggcagcttcttcacatggtgacaggagaggagtggggcggtgctacacactttcaaacaagcacatctagtgagaactcttatcacgagacagcacttggggatggtgctacaccattggaaaccagccccgtgatccagttacctcccaccaggccccacctccaacactcgggatcacaattcatcatgagatttgggtggcgagacagagctaagccgcatcaccaggtataaatgcaaatcagagcaattatgagatctcatttttctttgagaagttggcagaaatttaaatggttgaatcatagagtgctggcaaggagcctggaaatgggcacatttatttatacgttgctgtaggaagacggttgtctctaaatccttttgggaagataatagttggtgtgaggttgtttttttttttttttttttttttttgagacagaatcttgctctgttgcccaggccggagtgcagtggcgccatcttggctcactgcatcctccgccccctgggtttaagcgattctcctgcttcagcctcctgagtagcttggattacgggcaccaccatgtccggctaattttttttttgtatttttagtagagatggggtttcaccatgttggccaggctggtcttgaactcctgacctcaagtgatccacccgccttggccccccaaagtgctgggattacaggtgtgagccaccacgcctggcctggtatgagttttaaagtgccctgaagcaggggtcctcaacccccgggccacagactggtagcggtttgtagcctgttaggagctgggctgcacagcaggaggtgagtggtgggtgacagagtgaagcttcgtctgtatttacagccgctccccattgcttgcactactgcctgagctctgcatcctgttagataagtggcagcagtagatgcttataggagcgcgaaccctattgtgaactgcacatgcaagggatctaggttgtgaccccttatgagaatctagtgcctgatgatttgtcagtgtctcccatcacccccagatgggaccatctagttgcatgaaaacaagctcggggcttccactgattctgcactgtggtgtgttgtataattatttcaattacatattacaatgtaataataatagaaataaagggtacaataaatgtaatatgcttgaatcatcccgaaaccatcccacccccagtccaagtccatggaaaaactgtctttcatgaaaccagtctctggtgccaacaaggttgggggctgctgccctaaaattttttatagtgagaaacaaatattaagacctcaatgctggtttaaacaatattacattattttaaattgaggaatcatacattatccacacatccaaggagctcagaagaaattaaaaaaatcatacattagtttttccttaggcaaacaatattacatatgtgaatcttagcaaatgttagccatcattttcatagggcctgtgaacaatatttggtcccatttgcaacctaattattttcacattttaaagtggtttatacattttatatgcatttgacccttgaacaacgctagagttaggggcaccaaccccctgcacagttgaaaatccacatttaacatttcactccctctaaccttagctgctaatagcctgctgttgatgggaagctttaccagaaacataaatagtcgatcaacacatattttgcatgttatatgtattaagtactatattcttacaataaagtaagctaaaggaaagaaaatattaagaaaatcaggccgggtgtggtggctcacacctgtaatcacagcactttgggaggctgaggtgggaggatcacttgagcccagaagtttgagaccagcttggacaacatagtggaaccccatctctgcaaaaaataaaaaaattagccaggcatggtggtgcatgcctgtagtcccaactacttgggaggctgaggcaggaggattgcttgagcccaggaggtggaggcctcaatgagctgtaatcaggccactgtactcctgcctaggtaagagagtagtgagagcttgtctcaggaaaaaacaaatgataaggaagagaaaattatgtttattattcattgagcggcagtggatcatcatataaagatcttcgtccttattgtcttcatgttgcgtaggctgagtaggaggaggaagaggagggactggtcttgttgttctggggttaccgaggtgaaagaaaatctgtgtataagtggacctgggaagttcagacctttgcagttcaactgcatttgatttccttttcaagtacctcagatgtctggcttaacagttaaaatttcagtgtaacaataattataaatttatgagtattattatttaataattcttatatatttactagttatgctaaaattctaaaatttctaattctaaaattctcttaaatgttctaatactgtgtcgtaagtctgaattaattgctgagttataaactttggattggagttatattaaacattgcagtaaaaataccaaatacattcacatttttttctaacacatcaaatattaatattatgattttaattaatcttctgaggattacagctctatatccatttcaggaagcctgttaccagcccatttaacttgaggtaatgtactcactaaggaacagtgttaattgaggttacctctggagcctggaattctgtttggcttcttgttggtgacctggtaggacacagtgagtccgactgtagttgccgtcccaggtgattcatttactttaaagagcctggcccctgacttccagtgatttgatagtgtctgattcttgtatgcactcacagaaatctacagcaggcactggattgatcattggattgtatctttcatctctttgactcataagatgtgaaaatgccttttcctcttaagtcttttattttcttaaaacctagaattctgttggatatttaagatgatacctggttgagttttggatacaactcatgtttttatctgatttatggtctctcctgatagtctggcaatacctgttaacattttaaaacgtatattcacataatcttttgtgactcaaacggatagaagaagtagtactatatgtagatatttgtacaaaaggtttttggtagcattgtttattgtggcaaatatgctggaacaatctactgtgtgggtatggttcaataatttatagtgtattttcttcttatttacttggttaaatcatctaaaattatatgtgtacattatattaaaacatagccaacagttaatgtttatttataataactatttgactatcagtcatatgtaggcaccggtttaggtactggaattgaatcagtcactacaacaggcaagaatctctttttttcatggagcttacattttagtagggtgggagacagatgaaaaaagcaatggctaagtagtatgttaaactgtgatgactgctacagaaaaggaaaggaagggtaatcaggagtactgggggctcgggtgtgtgtgtgaggatattaaatagggtaagtgtcactgagaatgtgacacgtaagtaaagaccttgagttgagggagtgagctgtgtgtctctctgggggaacagccagttcaggggacaagaagggtagccaaggagtgtgttggtggtagcaagaaaataaaaatcttttaaaaagagtatccatataaatagagaagctggaggttaaaaaattggatgagtatttttttttttaatttggcaaaatagcgtgaatagtatatgttgaaggaaacgctaagtgggtggtgcaggggagagaggaagacttgcttgagcacatcgggaagtaggacaggaagggttctctgtttgccttgtaggttctaattgccatggcaataatataattgctgtggccgctgcggtaggcaggagggctgcctgtgaagtcaggatcaccaggctttgtggcttcaaggaggccaaatcaccatgggcttgcttgggcttggaggtgcgacctggtgggcctgcagaatgcgacttggtggcctgactgagcagcacgtgagggcctggtgcagcctggcatggtggtacccttgagagcgtggcctagagggctccgaggtgcagcctggccagtgtggtctggaggggtctggcaagcgctatctggagcactcagaggtgtggcctgtttttccgggtgggtctagtgagtgtagcttggagtgctgggtggtgtggcctggctggcaccgaggtccctgcggattctggagaacctcaaggtgcggccccgggggtgtggccaagtgtggtgtgtggagggcccttgtgtgcagcctggtggttcctgtgagcatggtttggagggcctggtgaatgtgtcctggtaggcctggtgagtgtgtgagcatggcctagagtgtcaccaaaccaaagtggacccgcctgcctgtgcaccagggaaagccaaacaccaaagcgcagggtttttgctggagagagtggactgcactgcgacgagacaggaggaaaggtcaaacctgtctccccaagctggcggctgggtcgggttttataagcataagcttattaccataaggtaatgaggtgtgttctgattggatcttgcaattagatgacaccagggctctatctgattggatcctggatcttgccatgtggtgtgcgcttcttatttcagtcccgctcctcagtccagcgcttaggttcctcccgtgttgcaagcttggttcatctgtgcaggctccggtgacatgatgtcgaactgggagccatggcagctgaaaaacaacgaacagctttgtacataaaagatgatacagcttggtctaatgtggttctaaggaggctctgccggcgagtcttaggggttccggcgggcagccgcgtgaacctggagcttggggtctgcagtgctgggaggccgaggcctggcatgttggggacaggtcttgggagctgactgggggcctggcgtggtggcggcagcccgcagtccctgcctggcccttgtctgggaggccgcggttctctgcggcctctcgccggtgtcgcccttggccactgggctgcgaggaagccggcgaggagtgggtgtgcgccccgcccggctctaccggcgagggatgcagtggccgccagcgtggccgtgcggctgggtcactcccttcccgcttccagggcctttttctgcctccttttcaggacgtgacccgcacattatgagggacccgtaggggctcttgacacagaggggtcaccctatgtgtgaacaggttacgaggttgggggcttggcttctgaacttgccaggaaacaccgcatcccttttcctgcagcggccgccccccatcccccacccgccccattctctcccctccccaactgcagccttccgcgcctccttggcccctcgagcctccctgggtcccctgcacctccccatgtcccccacgactcctaggcctctcgcgcttccccaggaccccgcgcatcctgggcctcttgcgcctccccggtcctcagcgcctcctcggccgccgtgcctccccgcaccttttgcgcctcatggggctcccggtgccttctgcccgccgcctcgccgcgcccctcgcctcctcatgcccctccgcgccccatacctccccacccctgtgcctctctgcctatcccctgtaccacccggcatcctccgtgccccatgcgcctcacccctcacgcctccctgtaccctgcatgccccgtgtgcctgctgtgccccacgcgcctcccccctcgcgcctccctgtaccctgcatgccctgtgcgcctgctgcgccccacgcgcctcccccctcgcgcctccccccttcgcgcctccctgtaccctgcataccccgtgagcctgctgcgccccatgcgccttccgcgtctccagccctcatgcgcctccagctgcgcatctccctaggcgggtacctcagcaccgctgagcccacccccgcccctgctcagtgcctcccagacacgcccactgcgggcgggacagtgggagctgtccaggcgcggagctgtccaggcgcgggagctgtccaggcgcgggagctgtccacgaggcactgaccttggtttcagagcctctgcagggcttctgtgtccttttggctgagccgactgggcaaaagttttagaaaagaccctgggtgttgcagatggagaaggatgatcgtggctgacttttgcttgcaggcagaagaaccacggggccatcagcctggtgctgtgggggcgcgctgactcgtggtccgcccctgccccaagacttcaggtgtatatgggattggatcagctatcatcccgagctcatggcacgtacagtgagccatgtgttaatccatagactaacctttttccttttaaaaaattagttgttttgtataatgtagcgagcactgtttccaacaaaaatctaggatcttggcagtaaccactatctgttttactctttcctctttcacttttcgctaggagtaatcattagctcccatcttgtattaatttttttttttttttactgtatctaatttccaaaaaaaaaaaatctgtgtgtttgcaactaagttatcttcctatgtgtaactttttgggacttaagtgataacagtaatattactaaaaatcaaccgtattgttgtttttcactgtggtttattccttctgactgctgtgatattttgtgtggatctgctgaagttaatttatccactcttctgttgatgggcctttggtcatttccaggtttttgctcttctgaagagcatgagatattctttcacattttctgctgtgcatgttccatatgtgcatggttttctcttttatatagacctgagtggagtaactaggtcatagggcacacgaatgttcaattttaggacataatgtcctgctgacttacatagttgttgaaccagttaacatttcactagcaatacaggagagctctgagccacctcatggctgacacttggtatttaatttttgccagagggatggttgtaaatggtataccattttggtcttgatttgaaattccttgatcaccagtaacattgaacatgtcttaacatatttattgatgtacatttttctttgatttgcttgatcatgtcttgttcattttatattgggttattgtgtgtgacctagattagaattttttcttttcattggatattaagatccaccattgtgtggctaggagtgggtttttccttctctctcctttccagcatggtgtgtgctttctcagtcagaggtaattcatcgtcctttatttcctggaattatacagacattcttttcttgtttgtttgcatgtgaatgtgtatgtagagattcttgatgctggttctttgccagttctgtgtttttcctagtttataacttacttccgttttctttaagctgttttttgatgagtataaactcttaaattgaataggtcaacctcattaatctttttgagtcttaagaaatctttctctatcttaagatttctgccaagttttgaagtttggattttgatgtttacatctttaatccatttagacaggggtgtccaatcttttggcttccctaggccacattggaagaataattatctttggccacctaaaatacactaatactcatgatacttaatgatctaaaaaaaatcacaaaaaagatctcataatgttttaagaaagtttacaagtttgtgttgggctgcattcaaagccattctgggctgtatgtggcccatgggccacgggttggacaagcttgtgtttagagttgatttttgtacccagtactgggtagggatccaattttgtctttttccatatggaaaactattttgtttccagttccgtttttatttccagttctgtttattgaacagcctcctcttttccctgacctattacttctgtcataatcaaagtttaattcacatttgtgtctctgtgctctctcttctagtcgattggtctctattctagtcttttgatcagtttattcctatgccaacccccatcatgttgatttttacatagactttttattctggactgttacagtaatgtcctggacaagcagagatgtggtcattctacttgtgggcctttctagagaatgttgattttgtagcatatgtgatgggaagtattgaaacatttcagtggctgagttatatatcctgatttgtatttttgaagatcacactggtgcaagatggatgaggaagtggggctggcgagggatgagactagtgtggaggcagggggagcagttaggtggccattgctggagcgcaggtagtggttttagcgggagtagaggtggagaaatgtggacagatttgagatgggcgtatagctgtggacctttctgatgtatagaatgcagcagacaaggtaaagatggcacttaatgtaatgtaatggggatgccactctgagatggaaaattctgggaaaggacagttttataaatttataagctatcagatacattataatgctacttttaatttgcttttccttggaaatagctgtttggttatgtatgttttatagcctgttcactctcttttctctccaaataggtgactctgttttgagaagtgcaaccagatctctcctggaattcaacacaacagtgagctgtgaccagcaaggcacaaatcacagagtccagagcagcattgccttcctgtgtgggaaaaccctggtgagtccacacaggcacttgatgtatttctttaaaaaaaaaaaggtctgccccttggtgttctggctgtagaggtattccaggaagaatcagtgagcaaacttagaaacacaaataagaaaaaccctaccaaatgaccatcatcatcaagaaccaataagtaaacaaattctaaacttgttacaacttttaagtaaaacatagaccatgtcttttgtaaaactacaattcaaagtgattactgtgttaaaaatcagtgcactgtttaatgtttaagttataggcatactttttttttctctaaaacctcttcttctagcatttcattttgataggttttagggcagcatatttagttttttaaaaaatatttttctttcctcatttatattaaattagagatacccacatctatttaggagaagccttggcccgtgggtatggggttctcaagttttttggatattacctggtgtttaaaggggacataattgtgtaaattattatgattgttcttattatgggcatattgtatgtaatttgttgattttaatctttagtttttggaaaggaacttgcagtaaataattgttttagctcttgggagaaggaattggtatacaaattctatgaatgttcttgaatcccagtaagaacccaatctttaggaaagtcaggttgagtgaaactctgtggctactaaattgctttaaaatatcattttagaatttgggactgtgactattgcatcttcaggtccacagtgtcttatctgaagaactttgaaaataaaactaatattgttaattttggatccgcatataaattgcatcgttgtgcatattgagacccaaaaaagaatctgttcgcagcagcattaaatgagatttatattacagaataaaatatatagctcctgttttaacttcagctaatttcctttatgaattctgtgttcaccataccagaaatagaactgtgaaggataactccctagacttgcacgtgggagtgaagaggccagttcctgctgtgcttgtgtcatcctgcgatgctggggttgacctgtttgtagtccactctggttgcggttaacaggaggggctgccttggagggttggcgtctggtgggtgtactaacttggtcagatgcagatgggctcctcatgggagccttttcacgggaagcatgaggtcacgttttctggctttcgtttgctggcatttgcttaagagaacatttggagtttgagaggagaatgactgaggatttcttcccatgaactcactcaatgtacttgcacagctggggcggtagaattcctttggattagttacacaaaatcccaacatgattttatgaagctttggtctcagaatttgcagatttgggaacctcttgatgaccccgtttaactaaagcggttgcatcccctgcccttcttgctgctgctttctttattttagtagcctttactgcattctcattttaaagaagaatctttacaatgtgtggtatggtaacattataattactatttttttttaatagggaactcctgaatttgtaactgcaacagaatgtgtgcactactttgagtggaggaccactgcagcctgcaagaaagacatatttaaagcaaataaggaggtaacatgggaacttcaaattacatgcttatgaagtatactctggggaactttatctttcaaatactgattctaacctttccgggtgaaaatcttttttagcttccaaattgcatttgagcagagataccatgtgatttaatttttaaaacttttctgagtggttcttatttttaggacagggcatttaaaatatcacaggatgtgatttttggtccagattggaaatagaatggctcatccatatagggcaagttagttcttggtttctggtgctgtgcaactcagtaaactaagtgacgtgtttgggcttgggcttagagtattcactctacctgcaggagccatctgtttctgacgctgcctgcttcatcttcctttgcacctggctttccacctgtgttgtaccccgcttttgataagtctcctttacctgtttgcattgttaaatctctctgtccctctcctcagccttgggatgacttctggctgcaatgtgagtccaggtcaggtatcccttaaattcttttccagctcacctcagagactagattactaggttactgttactattacgtccaccccttattatttgaacccagcattccttggtcaagacattcttcttgggtgcatgtatgtatatatatctatatacatacacactgacctatatgtattatgtgcaacatgatattttgaaatatgtatacattgaggaatggctacattgagctaattacatatgtgttacctcacatatttcgtttttttttttttttttgtgaggactcttaaaatctactctcttagtgatacgcaagaataaattacattgttattaactgtggttgtggtggtgtttaatggatctcttgggcaggtcattcttgttgactaatggaatgtccccttccccagcctggattccctcatgttgcactgctacttgattctccctggtcctggggaagagcagactgtgttccttctgccgcttctccatgcccaccaccccagatcctaaagggaatttcctgttctcaccttgataacaatcttaattaattgattatctcacttttctctcctactttctgtttttaagaactttcaaaggttgtaaggattcaggaactaatgaatggtcataatcagtaatttttactagtggcctaataccatgcagtttaataagacaaaaagaaatgtttatttaaaaacattaattcagattaaattatgaacaataaatcactgatattttcagatatggtcatctatgaagggaaagacagtgtcatatggaagtggaagtggtaaaatactgcccaggaaagccataaggagcattcaatgaaaaaaaaaaagtttaaagtggaaagaattaaggctgatatttaggagacagtgtcaaatgtaagcttcatttaaaaacttaggtgaagctgttagatgacatactgttagcggtgggaaaagcatctcaaagcagacatctgtttggggtttgggggtgagggtgggagcacagtgtgttcattctcgcagtgctataaagaaacacctgagactgggtaatttataaagaaaagaggtataattagctcacagttccgcaggttgtaaaggaagaatggcagcatctgcatctggagaagcctcaggaaacttacagtcatggcagaaggcaacagagtatcgagcacctcacgtggccagagcctgaggaagagagtgggagggggaggtgccgcccactttgaaatgaccagatctcacaagaactcactcactatcatgataatagcaagaagggggtgatggaatctgccctcatgatccagtcacctccccaggccccgcctccaatgttgaggattacaatttgacacaagatttgagtggggacacacagtcatcctgggattacaggcatgagccaccatgcccggctaatttatatatatatatatatatttttttttttttttgtttgtttgtttgtttatttgtttgttttgtagagacggggtttctctatgttggccaggctggccttgaactcctgacctcaggtgatccgcctgcctcggcctcccaaagtgctgggattacaggagtgagcccctgcgcctggccccacacacagtcatcctcaagtgtccagttggccggatctgagttgcttcctgtgggaggtggaggctgcggtgacagtggtgccctctgctctcctgttagaccccagacctctcagtcccacagatactctcctgggctctgattttccaacctgatcatgataccctttttgttttgttttgtttttgttttatctgagtgtacctcttatgtcacgttgctgaattgacagttgtgtcttctaccacctaggaaaaaattgctttccaaaataaaatgaatagcaacttgttttcaatgggtcagaaatcaccaactacagcccatggttcaaagcctgccctggcctgtttttgtacaaccccaggactaagaatggttttcacatttttacaggattgttacaaaacaaagaggaatatgccacagagacctatgtgacctgcaaaacccaaaatgtagataccacatggttctttgtaaaaaaaaaaaaaaaaaaaaaaaggtgctgatctgtgttctaaatagtttttggggtgggaatggggaggtatagtctgtgtttttctcaaaacaatgacatttaatttctcttagaagcagattgaagatgcatgagaaacatttgtactttgtactctcttacctcttcaggtgtaattggcagctggggctttattcattgagttttcatttattgagagcctattgtgagctaagcagtaggaattttgttaaattttggaatgctttcagggagcctatagactaatggtgtgaaggacatatccatattcattaactcatttttttttgtcttatggatagattaaatggaaagaactgaaaagcataatgactgctaaaaatgtagtgctgtcactgttagcaaatcttaataaagcgtatgcccttttttctgctttcagtttgatttgattacaccttacaggcttggtatgataagtttaaaacatattgaaggtttatgtacttataaaaacctcatcattccctaaagaaaaaaaatctcaatttggtttagtgtcattgtagtcttgctttctacatcttactaatgtctcatttatttattcattttgctctgtcacatttagaatgattttgatgggcaaaaatcatggtagttacaaacagccctttaaaactattgttatactttgttcagtggattctggtagaggctttaaggtaattatttctttaaagcattgtgtaaatatacctcctactgtagtgcccttgggaacaggcaaaattcagaactggcctgctagcagtcttaccagggttataaaagtaagattattatatataaaacagcattaactcaatgcgtggtgtgttgcagctggcaaacaacctcgctccccaggctgctaaattcgtggtcttatgaatgtctccattgctgtgtttgctgtagcaggaagtgggagggtgttccccagtagccttgactgtttaccaatgcacactccagttctgtggagtgctgtgtgaggcatgtcttctcttccctcctggagtagggagacagccagtagttgctacctgccccgagcagggtgcttgcagatcttgcctatgtggaatcctctaagtgtcttggtgaaatgcagctgttttcagaatgaagagttctttcattttcccttcttgccatatgccatcttgctcccttttccatcataggcttttattttgctggttagagaattgcatcttgtcttgcatcctacccagtccactgactcactcccctcttgggttaatgttttcatatgatcttgctgtgggatgacaagctttagatttgcaggataatgggcacttgtggctttttactgtaacccaattatagtctgtggcaataattttcttttagttgcctttctgcatgaatctggtggtaggcttaagctccatgtgctggtaccctctgagcactagaggttctaacttcctccattattagtagaaacacttaggtgtctgagaagtattttaggcgacaggcaactttgctttgaggatatggtcaaaatgagttcaagtgcctttgaggctgtgagtaggtgtaggtcgtttgattcactctattagctctccatgaatctctgacagcaggactggggaaaaaggttagtgggttagagcattcctgcagatttgatagcctatttctaagagaaatttgaaagctaaatattaagcagttaacttttgtaaatagacctgtctgtgaattgcttcagtctaaaagataaaattttgggaaacttatccacagaaaataataaaactatctactttgaaatgatttcagagaacatgaagttttagaatattctttggaagaggtaattaaaatgatgccagtgtattattttggaaataaaacttacaggaatgtttcacatagtcatggttcacttggtgaccagggccttttttactctgggggggattcctttctgggcttgagttcttgctgtgatgcggaagttgggtgcccctacttcatgaaactgtaccgcaaagatgtgggtgcccctacttcatgaaactgtaccgcaaagatgtgggtgctcctacttcatgaaactgtaccgcaaagatgcgggtgcccctacttcatgaaactgtactgcaaagatgtggcctcagagccatggtttctgtcctgggcagggagtcttgcagcctggggcagtttcaccatctgagcacagaccctgatatagtttggattttgtccctccccaaatctcacattgaatttgaatccctaatgctggaggtggggcctggtggaaggtgattaaatcatgggggtccctcatgaatggtctagcaccatccccttggtgctgtcctcatgacagtgagtgaattctcatgagatctggttgtttcaaagtttctggttgtttcactctcaccgtcttgctcctgcttttgctgtgagatatgcttgctcccacttcaccttctgccgtgagtgaaagctttttgaggcctccccagaagccgagctatgcttcctgtacaacctgcagaactgtgagccagttaaacttcttttctttataaattacccagtctcaggtatttatagcagtgcaaaaacaacctaatacagactgcttgggactgggctggcttttttggcctgctgccagcgatgggccacaggtgggagactcactgagttaagggcattagaacttggtgggtcctgctattgcctgctatgctgtggagctcaggctgcacctctttttaccatgtgggctctttgatgtggtagaggcgcctctgtccctccccagaatgttgccctggaggcccgctgatcaccgttggggccagtgcttgtctcagctgttggagagcctgaatatgtgcttgcctgacccagctccacccagctttccttcctcaatctgccttgctggcagaacacaagacagtgatgcttaggtgtcccatggccccacccattgtctgggacatgggagtagcctcctcgttaacaaaagccaagcataaatcctgttgccaccactgcagctgcctctttcctgcaagtaccacttcctggccaggagatgaacttgcgtagcccatctgctgagacaagtgcacaattgcacagtgctacggcaggagacaagctttccatgacctcagttaccatcatccctcaccacaccctggctactcagaaggccctgagcctgctcaccagcctggtatattactactacaactgatgtttgagaaagtcaccacacaaagcctatctataaccaaggaattcatacagtctttgacgctgaaagcgtccagaagcaaagccaaataaaactatgcaacatacattatagtcacattctcagggcggggggaaccctctagtcaaagcaaaagtaaattcaaaccaaaaagtgacagtttctctagatgagaaggaagcagggtaacaattctggaaatatgaaaaagcagggtgttatagcaccctgaaggatcatattaatcttccagaaacagatcctaaccaaagtgaaatgcttgaaatactagttaaagaattcaaaatattaattttaaagaagcttaatgagatacatgagaaagttgaaaaccaatacaaagagatcagaatatcaatccaggatataaatgagaaatttaccaaagagatgttttaaaaaaatcaagtagaatttctagaaatgaaaaatttattataggaattataaaattgagttgaaagtttcaaccatagactagacgaagcagaaggaagaatctcagaacttgaagacaggtcttttggattaatccaatcaggcaaaaacaaagattcaaaggaaatgaacgaagtgtttgagaaacgtgggactacatgaaacatccaaacctataaagcatagatattactaagggagaagaacaaacaaaatctggaaaatgtatttgaggacataattgatgtaaacttctttagtttagcaggagatctagacctccaaatataggaagctcaaaaaattctaaggaaatatgttgcaaggaggacttcaccacaacatatagccatgagactgtatgaggtcaacatgaaggaaaaaatcctatccacgagaaaagtatctaatcacctataaagaaaatcccatcaaactaataggggacttctcaggagaaacttaagagccagagagattgggtttctcttttcaaggtgcttaaggaaaaaaaatctgtcaaccctgaattttgtatcctgccagaataagtttcatgtatgaaggaaaaataaagtctttctcagacatgcaaatgctgagggaatttgtcagtactagatggaccatacaattaatgcccaaaggaggtctatacagggaaacaaaagtttgatacttgctatcataaaaacacacaaaagtataaacactcttataaaacaattattcaaacaagaccacaaagcaactaggaaacagttagcattatgacaggaataaaacctcacatattaatattaactttgaatgtgcatggattaaatgctccacataaaagatacagattgggagaatggatttaaaaaataaaagacagaatccacccatatgctgcttacaagaaagccagaactaattggtaaagacatacactgaagctaaagggatggaaaaagatattccaggcaaatggaaatcaaaagcaagcaggaagacccacctatacttagataaaactgactttaaatcaacaacagtaaaaaaaaaggaaaaagatggtcattatatgataaaaagattattcaacaagatgtaacaatcttaaatatgtatgcatgcaactctagagcacaagattcataaaacaactgctggtagacttcagaaaagaaatggacagcaatgcaataatagaattcaatcactgagaaagaaaatcaacaaacacggcacataaattggattcaggaccacgtagacctaacagatatttatagaacattctccccacagccgcagaacatatattcttctcatcagtgcatggaacgtttttcgagatggactatatgtcataccaaaaaacaagtctcaataaattgaaaaaaaccaaaatgataccaagtatcttctcagaccacagtggaatgaaactagaaatcaattcacagagaaactctcataactatacaaataattggaaattaaatagcctgcttctgaatgaattttgagtcaacaatgtagttaagatggaaattaaaaaaaaattgaaacaaatgaaagtggatacacagcataaaacctgcgggatacagcaaaagcagggctaagtgggaagtttatagtgttaaatgcctacatcaaaaatagagatcacaaattaacaacctaatatcacacttcaaggaactagaaaaaaaagaaaaaaccaaattgaaacctagcagaacagaagtaacaaataccagagcagaactaaatgaaatggagaccaaaaaatgcagtacaaaggataaaaaaaatgagaagttggttctttggaaagataatattcatagactgttggtcagattaaccagaagagagaggattcaatcagaaataagaaagtagacattacagctgataccacaaaaaagatcataagagacttctgtgaacatctgtgtactcacaactgagaaaatttagaggaaatgtgtacatttctggaaacattcaagttcctgagattcaaccaggaagaaatagaaattccaaaaagaccaataacaagtattgggattgaatcagtaatttaagaaaaacaaaacaaacaaaacaaaacaaaacaaaaacctcccaacaaaaaaagctcaggaccagacagattgacagctgaattctcccagaggcacagggaagaactagcacaaatcctactgaaactgttaccaaaaatcagaggagggaatcctccctaactcattatttgaagccaatattatcctgataaccaaagccaaacaagcacacaacaaagaaagaaaactagaggccaatatctatgataaacagattcaaaaatctcaacaaaatactagcaaactgaatgtaacagcacttcagaaaaataatacatcacgatcaagtgggttttattccagggttgcaaggatggttcagtgtatgcaaatcaataaatgtgattcaccatttaaacaatttaaaaaaaagtctgaccatctcaggagatacagaaaaagcatttgatgaaattcaacatcccttaatgaaaagacaacactcaaaaaatattagaagggacatacctcagaataataaaaggcatatacgacagaaccacagccagcatcgtactgaacagggaaaagttgaaagcatttcccctaagaagtggaacaagacaatgatgcccactttttcatctctcctattcaacatagtactggaagtcctacctggggcagtcaggcaagagaaagaaaacgcatccagatcagaaaagagacagtcaacgtgtctctgtgtgctgatgatatgatcttatacctagaaaactctaaagtttcctccaaaagtctcttagatttgatacgtgaattcagtagtttcaggatacagagtcattgtacaagaatcaataacatttctacacaccagtaatgatcaagctgagaatcaaatcaagaagtcaatcccatttataatcactaaaaaaaaaaaacccactagaaatacatttagccaaggaggtgaaaaatctctacaaggaaaactgtaaaacactgatgaaagaaattgtagatagcagaagtgggaaaacatcccatgttcatgaattggaagaatcaatatcattaaaatgattatattgcccgaaacaatccacagattcaatgcaattcctatcaaaatgccaacgtcattttttatggaattagaaaaagtcctaaaattcatgtggtcccccaaaaaatcttaatagccaaaccaatcttaaggaaaatgaacaaagctagaggcatcacaatacccacctacagattttactggagggctatagtaatcaaaacagctagtactgatagaaaaatagacacacagattaatggaacagaatagaaaacccagagtcaaagctgcatacttacaaccaactgatctttgacacagttgacaaaaacatacactggggaaaggacaccctatttagtaaatggttctgggaaaactggacagccatatgcggaagaatgaaactggacccctatctcttaccacatataaaaattaactcaggtcggattagcgacttgaatgtaaggcctgcctgaaactataaaattcccagaagaaaacccaggaaaagctctctcggatcttcgcctaggcaaagaattcatgactaagacttcaaaagcaaatgcaacaaaaataaaaatagagaaatgggactttattaaacttaaaaacttctgcacagcaaaatacatagtcagcagagtgaacagacaacatacaaaatggccaaaagtgtttttaaactctacattcaacaaaggattgatattcagaatctacaaagaatgcagacaactcaacaagaaaaaccacaatccctttaagaagtgagcaaaggacgtgaacaaacatttctctaaagaagacatacaaatggccaagaatctcctaaacatactccacatcactaatcatcagagaaatatacaaattattataaaaccacatggaatactatgcagccataaaaatgatgagttcatgtcctttgtagggacatgaatgaaactggaaaccatcattctcagcaaactgtcgcaaggataaaaaaccaaacatcgtatgttctcactcataggtgggaattgaacaatgagaacacatggacacaggaaggggaacatcacacacctgggactgttgtggggtggggggcggggggagggatagcattaggagatatacctaatgctaaatgacgagttaatgggttcagcacaccaacatggcacatgtatacatatgtaacaaacctgcacgttgtgcacatgtaccctaaaacttaaagtgtaataataataaaattaaaaaaaaaagtttaggaaaaaaaaaataaactgcatatatggaacgtaataaaaaaaaaccccacaatgagataccatcttataccagtcaaaaatggcaattattaaaaagtcaaaaaacaacagatgttggcagagttgcagaaaaaaaagagaacacttatacaccattggtgggaatgtaaattagaatgacctttatggaaaatagtatggaaattaatcaaagaactaaaaatagaactaccatttgacccagcaatctcactactgggtatctacacaaagtaaaagaaatctgtctgtcaaagagatacgtgcactcgtctgtttattgtggcactattcacagtagcaaagatacggaataaacgttaagtgcccaccaacggatgactaggtaaagaacacacacacacacacacacacacacacgtctatcatggaataccactcagccgtaaggcagaatgaaatcctatgttttggagtaatattggtggaacttgaggccattatcttgagtgaaataacttagtcagacaccacatattctcacttataagtgggaactaaataatacatacacatggacatagagactggaataataaatattggagcttcagaaaggtgagagggtgggagggcagtgagggttgagaaatgagaaatttcctaatgggtacaatgtacagtattccagtgctggttacactaaaagcacagacctcaccactgtgcaatatccatgtaatacaactgcactcggtcctcctaaatctaaataaaacaaacaaagaggcacccccttaaagctcagggtcttgccaactctaacagtggggtttcttgatgttttttaaaataaaaagaccattagttcataggtatgagagactgtcataaattaaaaccaagtaaggatggattgaaatacccacaggaggaactcatcttcacagtttatggaacaaatatagaacaaatatttactgagctcccactatgttgtaggcatcatctttagcctgcagtgacaaacccttgacctcaaggagcccctattatagtggggggaaaatgacaaaagtcaacagatggcagtacctagtatcatacatcacagtgctgtgaacaaaagtgaggctgagtatgggagacagagagaggtagagagtgctgttttaggtaaaggtgtcagaagaggccttactaagggcgatgtttcatcagagacctgaatgaagtgagggaaagagccatgtgtatatttgggtaagcacatctcaggtagagaggacttttgagtttcaggagggtagaattgcatcaagaggtgagtgtggctgcgttgagtgaggagagtggtaggttagggcggtgtcatgaaggagttggaatttccttctcagtgtaatgggaagctgctttgaacagggagaggtgtggcctgatttaattctgaagtgctaatcctgtgcttgtggagacatgggctgaggtagtagggcactgaagctggaattggggggccagttaagatactattgcaggcaagagattatggtggcttggacagggtggcgatggtggaggtgataagtagggagtggatccagggtttagtctgaagggagagctggcaggacttgccgatggttggatgtagacgtgagagaacttggcggtggggcagggggaccttaaggttttggctcaagcaactggttgaatgatggtgccatttgttgagatgaggaacactggggtaacagtaggttttgggggagaaatcaaaggctcattttaaatttaaatacatgaaatttgagatggttttgtgtatccaagtgatgatgataaacaacagcaataaataacacttatgccaacctgccaggagctgtaccccaagcttcacatacattagttcactcaggccttacagcagccccatgaaggaataactgtcattattccagtatggcacgtggggaagctgaggcatggaggttaacttcattcatggtcatgcaaagtgttcatgccagaggttgaaccccaagtgttctgcttcgagtctgtgcttataaacgtagcttctgctattgttggctgtgtaagcctgcagttctgtggaaaggtcaaggctagagacatgaatttgggagtctttggcagacatttataaccatgcacgaggtcaccaagggattgggtgtagacaggaaagagggctgctcagtaagctgtggcacacctctggattgagagtcagttagagggaaggtgagaagtgtttccaggaggctgaaaaagagctggaagtggggcagaagaaaaccaggagcctgtggatgcaagccacaggagaaggggtttcatgaggtggagaatgatcagtagcatccagtgccacaagagaccatgtaacgggaaggctaggacacgagcactggatgtgtcagcagagatgttgtgggtgagctggtaagcggggttttgctggagtgggaggcagcaagctgatgggactgtgttcaagagagaatggaaggcaggaagaggagaagacgtgtagggacaattgaagaaattttgctctaagttgcagagacatgagatgatagctaggggaatgtagggaccaggaaggacgtttgtgaggtggtagatctcatggcatgctgacggaaacgatccagtggagagggaaaacctggtgatgtaaagtgagaggagatgattgcacaacagtcctcatgtaagagagaagagataccgaaaagaacgcagaggagccaagacgtttattgacctttgcctgagttcgttattaggggacaccatagcatgatagtccctaaggaatggagagcagtgttgtgtgacattggtcataagcttttctgattgaccaagatgtatactgaagactcacttttttcttcctcccttccaggtgccatgctatgtgtttgatgaagagttgaggaagcatgatctcaatcctctgatcaagcttagtggtgcctacttggtggatgactccgatccggacacttctctattcatcaatgtttgtagagacataggtatgaatctttgtggggctgagggggtggtggtgagggatttcttctatggcttcaatatctttgcctttctacctttatttctgttttcacatccatgtttctgattaggccctctaataaagcttttgtccccaaaaatgttctatttgcacaacccacctcttctcccccagtagattccatgcctcctccccaacccctgtagattccatcctaactgttgatccattccatgtgggtgttctctcggccagacaccttgggtttcgggattctacagaagtgagggtcggtcttgttctctgtgtgtgcctgaatcccttggctctgagttacgggctgggtgaaaaagaaaaagggatgatcaaggacttgggtacttggtcgggatgcatatttggcccaagctgacttgttcctttctctgtacttgccaaaactggtgtgagaagctttagcttaagctttagaatctttgataaattaactaaagaccgtaaataaatggtctttatctaaaaagggccatgaaaagttttactaagcctttgactagccttcagctggttttactaagccaagtttctaaaacccagcttgatgttcccctcagggctatgaattgttagtcctgtaggccaggactgtctttctgcagtgctagccatgagtaaattctgctggtgattaactaatctaaaggtcatttttagtgttcttctttgttttttatttctcaaatagtacataatgctttgcccttagaaaagtttggagaaaattttaaaaaataaactcaatacatggaagtattgctggatagtagatgagtattaatttatgattattctttaaattatatatatacattatgtactatcttgtttatgtattatttctaaacagttaaaaacagtaaatataccccattcagggctcaccaaaagtaaccaatgataactaggtttttttgtgtgtgttagagtattacatctttcttttgttctccaaggataacctttattgattttttggaaaaagactaatacagtctttgtcttaaatgggtctgtaactcaagtttggttatagagttgatgagttgtagattattgaattctggaataatacgctattttgatttggaaaacatttaggtttctggtctcttaacattttacagatcatctgaatttgctgagtattttcttacaagttttttctttccaatttattggcaatttgagtagagcttgaatgactttgattcacagtaggggtgccctagtttttactcagacattctccattcccaggaaattgccctaagtctcaaaccaagattgaatgtgaccctcaaaacctcttggatagtttcggacttgccatcatgtgcttacctccttgcatcctcagggcgcttgctgtgtattctgcctttggtataccaagtggattgtcttacactgagtccccatgagggcaaggagcctatggcacagcagatactataggtggaacaaagcagtccatttgtgaaatttcataattccacataatttcataattgtttggaaggcttgagagttaaaggtttgcttacctcttcactagctggtgcaaaggtagataaccctctccatctttgattaataaggcaggtaaaacttaagggaggtaagattattcactcactcattcgtgggagaagggttgtttgaatcccttctgtgtgctaggcactaatctaggcactggattatagcactgaactcaccacagttcctgttttcctggaactttagttagataggagaaaagatagatagtaaacaaataaatcccaaagtatactgtgtaaggtattgagtcatggtcatagaaatgaatggtaaagagcaacctagctgtaatcatagctgttgctatactggcaatctgtaaagcctgcgggatgttctggacatattctgggtatgttttcatctttaatcctccaccaaacctgtgcagtagcacactggcaattggatagttttgtagttagaccaacgttatcgacatagtaagtggtcgatttaggatttgaacccagagctgtgggttctttccctaatctcctaattgttccagtcatctgtggagtgcctgcattttctagtctctgtagcttgaaaggggatagtgctaatgttgttgtacctcaagcagaggatgggtacatttcttgattacaaataacatcataacctgtttcctgtgcacctcttatataccagtgcagagccagtactttacagtccttcatcctgagctttgtttgcagagggttaatggcttgcccaaggtttcagaatagttacttagggagacttttaggaattcaataatgtatttaaagggaccctgggtctaagggtacgtgtgattatcactcctaacacctaatctgatttaatgtaatacatgattttcagacacactacgagacccaggttcacagctgcgggcctgtccccccggcactgccgcctgcctggtaagaggacaccaggcgtttgatgttggccagccccgggacggactgaagctggtgcgcaaggacaggtcagtcaaggcctccgatgctgttggcgtttttaatctccagcaaggacctgactttcagggagctgcaggaacatcctttttcagcaaggcttgggatagtccctgcagcattgctgcttcacatgtacttgtaagattgttggtcattgctgtgagtcacatagtctagtgtgcttgtctactttttaatcatttgtctcttacagcagtaaaaatacatctcatgatccagtccatagtacatacctgtatttgcctcatgaaataatgcctatcttaaggtgccatctgatatttttcattctgtggcacccgtgaaattgattttgtgtccattgtgttctcatcttgggagggcaagagacaggagggacagtttgctggtgaccttcactgggatgtgacagggaccttggttcccagtggggaatggtgttccttataatgtgttgtgccgtgtacatatgctcttgtactgcctttgtatcttgccttggcagacatacgcatttctctagtgtgttgcacatgaccatatcctgaacttcgatcaaggattcacattttctccccattcagaggcctttggtagacaccttgttgtgcttgctctagtctggagctcgtggcatgtctgggtggttgtagggagcatgtgcaattataatggcactctgtccaaagaaaaaacttgagcgtaacctgaggggaaaagtgtttggaattttctatgtgtgtgtctgtattagtttgctcaggctgccataagaaaatacgataggctgggtagcttaaaccacagaaatgtatttcctacacagtctaaaggctgcatgtctgaagaaggcgtcaccggggctggtttgttctgaggcctctctccttggctcgttagatggccgttttctttctgtgtcttcacgtggccttccctctgcgggggtctgtgtccgaatctcctcttctgataaggacaccagtgattttttggattaaggcccactcacatgatctcctttttccttgttcacctctttaaaggccctgtctccaaatatagtcacatgctgagctatggcttaggccttcaacatacaaattttgaggggaaacagttcagtccataacagagtctttaagtgacacattggtaattcttaatatgaatgagtttgtgtgacgatttagtaacatgtgggacactgagcaagtgtgagcttctcttgtgggaaaaggcaggtcatctgtgatcagctattctctagcaggcagccaggggcactgggccctttccacactgagtgcagtaaaccctggtggtgggggccatgttggatggtggtttgggtggtggaagagaaccccagttcagtaactgctgtaactgctgggcaggtgctgtggggttaagacaaaacaaaacttttggctggcacttagaatttgttgtataaagaggaaatgattgactagccttgtgggcaaaaatgcacctggcctgcttgtctgcctttttttttttttaattttgttatctcatttacaaccgttttttgcttgttttagtcaaatggtgtttcttcctttttttaaaaaaaataatttttttgttccttttctctttccttattctaggacatgaagcagatcaaacaggttttgtttttgtttttgcttttgtttttgagatgggtcttgctgtgtcacgtaggctggagtgcagtggtgtgattttggttcactgcaacctccgcctccctgttcaagtgattctcctgcctcagcctcctcagtagctgggactagaggcgcactaccatgcccagctaatttttgtagttttagtagagatggaggttcgctgtgttggccagggtagtctggaactcctgacctcaggtgatccaccaccttggtctcccagaatgctgggattacaggcgtgagccatcgcacccagccaggttttcttaatatatcaaatttatgtgctggtcactttagatatttgattttttaacaaaataacactcactggagtttacttaaaacttttttttttttcaaatggaaataaagtcattttataccatatctacttttatattttaatatttcttctgttaccctctcctcccccccaagtgaatgtgctgaatgctcagggcaacatatgaatttggatgtactttatacttttgtaatactcttttctcaatgtggctctcccaggcttgtcctgagttacgtgagggaagaggcaggaaagctagacttttgtgatggtcacagccctgcggtgactattacatttgtttgcccgtcggagcggagagaggtaagtgactcgtctcctgatcactaatgtggcgcacagtagcctgggttgcccatgcgaacgcgtttctgggcttggggcagggtgggcctggatgcaggaagctgggagccatgacagaggcactggtgggttctcaggagaagacaagcttcctgggatagcttctgtcacatgcagctcactcagggagagctgtttgcattttgccttttgcttttttacagcaatccggaggggcctccacatataatgggatggtgttttgttctagtctctgtgagattattttaagtagttcacggacagatttttttttggtagttgggttgttttagt

SEQ ID NO: 258 - DNA, 153707 bp, Homo sapiens
tttgctgtagaatgaaagggcacaattattttccagaaattgtatcatggccatactgtctgcagactctggtataatttcaatctctgcctccactttcacttggccttctccttgggaagcttcatgtcttcttataatgacacttaccataggatgtaaaacccatcaggataatccagaataagctcatctcaagatctgtaattccatctgcaaagacccttttcccagattatacccccaaaaaaccattttcctgccacgtatgccatttacattagcaccaaaaaaaaaaaaaacgcttaggtataatcttaaaaaacacacataaaagctatataaggaaaactgcaaaactgtggtaataaaaatcaaagatccaaataaatcaagagattccatgttcatggataggaagacaatattgttaagatgtccattctttccacatttataaactgagcacaatcacaatcaaaatctcagccagttattttgtaaatactgacaaagtgattttaaagtttatgtggaaagacaaaagacccagcatattcaaaacaacactgaaggagaagagcaaagcataaggactgacctactgaaaacttaccataaagctacagcaaccgggacaatgtgatattagaaaagaataaacaaataagataatggaacaagagaaagagcacagaaagagatccacacagatgtagtcagcttacctttgacaaaaaccaaagacaatgcaatggagaaaggacagactttataacagatggtgctggaacaactacacatccacatgcaaaaaagaaaaacagaatctaggcataaacattacgcttttcacaaaatttaattcaaaatgagtcatagacctagatgtaaaatgcaataattgtgaaacttgtggaaaataacataggagagaatctagttgaccttggttttggcagtgtttttagataccacaccaaaagcacaatccatgaaagaagaagttattaaatcaggtttcaatcaacttaaagactcctgctgtgccaaagacacttagtagaacaaaatgacaagtcacagatttgtagaacatttttgcaaaacacatctttaataaaagacaggtatctgaaacttacagcctgaacaatgagagaacagataacccaatttttaaattgggcaaaagatctggacagatagtttgacaaagaagatatacagatgacaaacaagcatatgataagtgacatggtttggctgtgtccccactcaaacctcatcttgaattgtagttcccataatctccacgtgttgtgggagggacctggtgggaggtaattgaagcattggggcagttaccctcatgctgttttcatgctagtgagttctcatgagatctgatggttttatatggagcttctcccctcttcgcactgcacttctccttgctgccaccatgtgaaggacgtgtttgcttcctcttccaccatgattgtaagtttcctgaggcctccccagccatggtgaactgtgagtgaattaaacctctttgctttgtaaattacctagtctcgggtatgtctttattagcagtgtgagaatggactaatagaataagatatgaatcatatacccttagggcagagtaaattaaaataactttgatgtactactacttacctattagaatgactaaaattccaagcattgacaacaccaaatcctagtgaggttgtggagcaacaggaactctcagtcattgctggtggaaatgcaaactaatactgccaccttagaagacagcttagcagttgtatgatttttttccaaaactaaacatactcttaccattcagtccagaaattatgcccccttggtattgacctgaatgagtagaaaatttatgcccacataaaaacttgcatacacatgtttacagcagctttattcataattcccaagcttacaaggaaccaaggtgtccttctgtaggtgaatagataaacaaatggtagtacattcagacaatgcagtactattcagtccttaaaagaaattggctattaagccatgagaagacatagaggaatagtaaattcataggcttaagtttaaaaaaaaaagggctctgtaaaggctacataccgtatgtcatacctacatccaattatctgtcattctggaagaggcaagactatggagatattaagaagattagtagtaccaaaggatttcaaatagaaaggggacagggaataggtagggcatacaggatttcgagcagtgaaactatcctgtatgttacttatagggtgggttcatgtcctatacacttgtaaaaactcatagaatgtacaacacaaagtatgaaccctgatgtaaacttcggactataaaataatgtatcaacattatcttatcaattgtatcaaaaggaccacactaattaaaataataatgaggaaattgtgtgtgtgtgtgtgtgtgtgtgtgtgtgtgtatgtgagagagagagagaaagagaaagaggtggggaaaggggggtgtataataactctctatactttctacttaattttctgtaaacctaaaactgattttaaaaaataaactctattttaaaaaaattcaaataaatgatttgaatagacctttctgaatttctgaaagaaagataaacagccaatatggatatgaagaaaagctcaacatctaacatctttagacattagggaaatgtaaatcaaaatcaaatgagatacgactttcatacccaataaaatgactataataaaaaagacaatgacaagtaatgatgggatgtggagaaataactgaaatcctcatatgttgccagtgagaatataagatgatgcagtcattttggaaatagtttggtagtttatcaaactgtgaaatatgtaattaccatatgactcagcaattcttaggcacatacccaaaacaaacgaaaacatttccacatgaaaatgtatacacactcggctgggcgtggtggctcacgcctgcaatcccagcactttgggaggccgaagcgggtgaatcacgaggtcaggagatcgagaccatcctggctaacatggtgaaactctgtctctactaaaaaaatacaaacaaattagccggatgtggtgatgggcgcctgtagtcccagctactcgggaggctgaggcaggagaatggcgtgaatccgggaggcggagcttgcagtgagcagagatcactctagtgtgcactccaacctgagcgacaaagcgagactctgtctcaaaaaaagaaaagaaaagaaaagaaaatgtatacacactcagctgcattattcatattggccccaaagtggaaataatccaattattcatcaactgatgaatggatacacaaatgtggcagatccattcaatggaatatattcggccatgagcaatgaagtagtactaacatatggcacgacatggatgaaccttgaaaactttattagactaggtgagaaaagccagacacaaagaccatagagtatataattccatttacttaaaatgtccaacatagggagatccatagacatagagagtagattagtggttgcctagggctggactgagagataaggtgtggagtaattgctaatgagtacatagacacagggttgctttttgaggggtcatgaaatattctaaaattacgctatagagatagatgtacaactctgaatatactaaaacccactgaattatacactgaattaaaactttaaaaagtcgtttgcatttatttagtgcattacatattagattttgcactcttatttatgtttttccatttgagcctctcaataaaatttgatattaattttttttttttttttgagacggagtctccctctgtcgcccaggctggggtgcagtaacaccatctccgctcaatgcaagctccacctccagggttcatgccattctcctgcctcagcctcctgagtagctgggactacaggtgcccaccaccacgcccgctaatttttttttagtagagatcgggtttcaccgtgttagccaggatggtctcgatctcttgaccttgtgatctgcccgcctcggcctcccaaagtgctgggattacaagcgtgagccacagcgcccggcctacacgtggcttattcttgtcctaaccgttggctccaattggcggccaagctagagtgcaaatatatgaaccttttcccctactctgagttctcatgttctccccttggggtccctgcacagtacagaaacagactgtggcatggggattcttagagattctgttcaatttgtccaaatactttagttacagttgtatggactatatgatggttcaatcatgttgcaataagttttgacacagtatgatgcttattggatttggagggaacatgttgataacccactttgctcttatttgcaaggacttaggaaggtattcatgtaggtcagtgatctcaatacttcaagaaaccctggggaaccacagaggcatatcctgagattattacaaaatgttgccctttctgagccatcattttaattttcacttttagtcttgacaaagtgtatagactcaggagccagggagatcgaggtcagaatgataagtcattaatagcttggcaatcttacatatgaattaaagcttctaaagtacaatgttctttttttttttttttttttttttgagacagagtcttactctgtcacccaggctagagtgcagtggtgtgatctccgctcactgcaagctccgcctcccaggttcacgtcattctcctgcctcagcctcctgagtagctgggactacagatgcccaccaccaagcctggctaatcttttgtattttcagtagagacagggtttcaccatgttagccgggattatctccatctcctgatctcctgaccttgtcatccgcctgcctcagcctcccaaagtgctgggattacaagtgtgagccaccgagcccggccctacaattttcttacaacaaaaatgggatgataaaaattttaccttttaacaaaaacacctaggacacacaatgcagaaaaaacagtctctttgataaatggtgttggaaaaactggatgtccatatgcagaagaatgaaattaaatccttattccataccatatacaagtatcaactcaaaatggcttaaatactgaaatgtaaggccccaaactatgatgctactagaaaaaaataggggaaaagctccatggagttgctctgggcaataacttatggatatgaccccaaaagtgcaggcagcaaaagcaaaaataaacaaatagcattacatcaaaatgaagaactgcacagcaaaaaaaaaaaaagaaaaccaagagagtgaagagaaaatgtagagagtgggagaaaatatttgcaaactgtgtatctaataagtggttgatatgcaaaatatataaggaactcaatcaactcaacagtaagaagacaaatgacctgattaaaaaacaggcaaagtacaattagtagatgccaatgaaaaataaaagcaaaaatatgggcaaaggacctaaacagacatttcataaaagaagacatacaaatggccaacaggcatatgaaactatattcaacatcactaatgaggaaaatgcaaatcaaaacctcagtgaggtgtcaccttacacctgttagaatcgctattgccaaaaagacaaaaaatagcaagtgttggcaaggatgtgcaggagagggaacttttgcacacagtcggtggaaatctaaattaatacagccattacggaaaacagtgtgaaggtttctggaaaaactaaaaaaaaaaaaatagcattacgattgatccagaaatttcactgtggagtatatacccaaaggaagtagcatcagttttgacagagatatctgcactcccatcatttattgcagcattagttgtagtaccaaagatatagaatcaacctaaatgttcatcaatggatgaatggataaagaaaatatggtataggccgggcaaggtggctcacacctgtaaccccagcactttgggaggccgaggcgggtggatcacgaggtcaggagtttgagaccagcctggccaagatggtgaaacaccgtctctgttaaaaatacaaaaattagccagacgcagtggcaggtgcctgtagtcccagctgctggggaggctgaggcaggagaatcacttgaacctgggaggctgaggttgcagtgagccgagattgtgccattacactccagcctgggcaacagagcaagactccatctcaaaaaaaaaaaagaaaaaagaaaagaaaatatggtatatatatacacacaatcaaatgctacacagccataaaaaaggaaaaacttgtcattgatgatagcatggataaatctagaggaaattgtaagtgaaataagtcaggcacagaaacacaattaccacatgatctcacttacatgtgtcatatacaaacctgatctcataaaagtagagagtaaaatggtggttcttagggcctgggatggttggagggtgagatggggagatgttggtcaaaggataaaaaattttagttaaataggaggaataagttcaagaaatctattgtatagcattgtgactattagattagtgaggtagagcatgtgaaagattgtaagagcacaatgccttcacatattatttcatcaataaaggtcagcccattgttattacaaaaacaaaagcaaaataaagactatctgaaaattgttagtagggtgagttaaaactagagtgagcacaggacctccgatcaggcgactatagtagtttagaacagaggcagtgagttccttaactagagtacaggagaagaggaaataaaaagtatagaacaaataagagaagcatttgaaggttcgattgaaagatttggtaacattttagaggtgggcaagggaaagggaggagccagatgtgaccccgagatttctgagtcagaataagcaaaatttggatgctgccattcaatagaaaccagctggtaagtttttcttacctttaatttttagttgggtgtgtgtgtaaaactgaaataaacccaggaaaaatctataatcaaatggttttttgctttaaaataaaaatagaggccgggcacggtggctcacgcctgtaatcctagcactttgggaggccgaggcgggtggatcatgaggtcaggagttcaagaccagcctggcaaacatggtgaaaccgtgtctctactaaaaatagaaaacttagccaggcacagtggcaggtgcctgtaattccagctattcgggaggctgacgcaggagaatcattttaacccgggcggcagaggttgcagtgagccaagatcgcaccactgcaccagcctgggcaacacagcaatactccatctcaaaaaaaaaaaaaagaaaatatagattcaatgcttatttgttatgaactgataatccaccattatcacaaatacctcttgcaacttgttagctcctttgcagattttttaaaaattcctacttgcaggcttggttcagaagaacctgtaaaaggagatccctgaaatcagaaggtgtaacttctctaaacctgcatgaatgagaaggcagatatttgtgctttctgctacgtacttactttcagaaaatttgaataaagacaaaggaattattgttatttttttcagtgtgagaaaatgtctacaattattggtgatgcatatgtaatgttgatctgctttttgttttgtttttagacagggtctcactctgttgctcaggctggggtgcagtggcaccagcagggttcactacagccctgactttcccggcttaagtgatcctcccatctcccatctcagcctcctgagtagcttggactacaggtgtgcaccaccacgcctggctttttttttttttttcttttggtaaagatgcagtctcactatgttgcccagggtcgtcttgaactcctaggcacaaaggattctcctgcctcagcctctgaaagtgttgagattacaggcgtgagccaccacacccaacaggtctgctttttgagataatttttcttttttttttttttttttttgagatggagcctcgctctgtcgcccaggctggagtgcagtggtgcgatctcggctcactgtaagctctgcctcccaggtttatgccattctcctgcctcagcctcccgagtagctgggactacaggtgcccaccaccacgcccagctaatttttcgtatttttagtagagacagggtttcattgtgttaaccaggatggtctcgatctcctgaccttgtgatccacccgcctaggcctcccaaagtgctgggattacaggcgtgagccacaacgcagtcttgagataatttttcaaaaaataaagagagaataagaaaaggcaaaagaatacataaacaaaatcttggaattattgaatctgggtgatggaattatactggatctttctttatagcttttttattacaaaaagaaaataagtgataattataaataccaaaaatcaagatactttgaatagtggaacaaacagctggaaaactttgagatagcttactgctggaacacgtgctaaataaataacaagcagttttgttcttggttctttgttacttgcagttgaacacgttaaaaccaatacccctaattctactacactttatgttatttttattatttatttatttattattattttttttttttgagatggagtctcgctctgtcgcccaggctggagtgcagtggcgcgatctcagctcactgcaaacactttatgctactatgaatacaattttgaatttatatttaaacccattgacaaaagtacagattttctcatagttttaagagctgactataatatgaagccttaagattgacagagcatttttccttttaaactatagtgctcttcaaaaaggtttataaattagtctatgtaactagatcattcaaaagagtaattaagctttttacacatatacaataagatttgcaagaagggcaaatagacaacaaaatctgtgtatatagaaataatcagtttaaggaagtaaaataaatatatatgtaaataaatatttgtagttggtgtgggtttcagctgagagacggcagctcactcacacctgacagaccataatctattttcaaagtagggggataatcagaacagaaagaaatgtaagtgtcagttaactcaagtaaagtcatgtcctgcttctcactaaatgctcacaatataagctacatacaataaaattataaagagatataaatatgagtctctactaaaattgtactttagcaaacagctaacagcatgcttcattcatgtcatctttaagtaaatatatgtagtgcccacaaaccaaactttcttttcttcaataatcatgaaaaatataataccagcaagtttggtcataattttctatgggtaaaaatcactagatatttaactatacttagtggcaaaaatcacatggtatcttagcaggttttctctccaagaggttttatttgatgtttgacttaaaggttatgtagtgccatgaaagggcacatagcctatcttttcttttttctaagtttcatctaccaccacttagtggatagatatttcttgagtaccttcacttagaattctatctgaggcttttaacaatatcaatagtcattttgcccatgtgtgtagaagatctgtggttgctcgggggttttgtttttataacacactaaagtaaatcagaagtgaaagcacttctctctgagattatttttaaatctaaacaaataaataaactcaagggaatttaattttgataaaataggactccaggaaaatctgtctcatggcctttctgaatgaagaaaatggaaataaaatgtaaatgtgattttggagatgtgtcttccacaaaacaagtgttgacaagataatctctccatttgttccaggtcctctaattctagcactctataagcataaaaataatctaattaagtttaatgctttgaaatatttcctttattgcaaatcagtacccagatgaagaataagatgaaaccacacttacatgactctaaatacctgagatttctgagtaaggtggggaacaaagatctgtttctctaactaaaggatgattagattaatttttccctccattagcagccctatatctttctccatcctctctcacttgttactcaactatttgagcttctctatcactaaacttataacgtattccctgcctgggcttcaaagcgatattcacattaacagataaaaagcttcatgcactgtctgagctaagactgccacagtaaactctgaaatgatgacatgagagcatgataaatatcctgacacaaaaaagctatttttcaggggaggccactaccccataagcaaacctttgttgctctatctgtgaactcaaggatctgtcctcccattgaaaggccccagagtcgacaggctgagtactccaagtcgctgacaccaggggacagaacaaagaatctgtccaagtcttgatctccttagctcagcgcaggccaagttcagctcagcgatctatcaaagtgctggaatgtgcagcaagtaaatacccacattctgccaagggagaagaaaagctggaccattgactactgttctgggacaaagcaaattctcccacatcaaaagagcacaagcagccctcatccaggtctacactgtataatgggtagattttcggcgagtgtgcaaaagataaatggtgcttttatctcacattcccccaccccccttgcaatgagagtttatgttagagccacttaactgcgtggagtgcagcttggtggattacctgtttgtatgactcagtacctgacctgatcctgtggcgagaggagacgggggaggatgagagttttgtaaaatcagttttgctttgaagggatcttcagcaatttctgaagcctcacaaagacctctatacatactggcccttataaggagaaaggattagaagggaacaatgcacccagtagagaagttcgtcttgtatttctagttattttatgagtttagacttattaaattacaagctttaaaatcagccactcattattgaaaaaagtgtggaattgtgaattaaaagcgtatctctgagacagttgtcactggctttggagctaagcatcccgggaagtcagataaggtttcatcagagaaagggaaatgatcctgttatgaataaaaattgaaaggttctgaaagtcacttctggaagaccagcatggtgaggacaggaatcttaagtgttaacaaggttggacttaaatacctaaaatgattaattggtcaaactagcatgaggttaaagcttttttgttcctaaaataccttttgattccaggaagaaattcttttccccaagccgccctgagtgaaccattagtttccatttcagtgatctgctttctttctgtgtgtaatctcaagtctcacctgagggcagatggcggggcgatgacaatggcagcctatcagagaatgtgatttccaatctcagctccacaatccaataccacattatgtactaagtctagctattaaggatgtctaaggtctaaagttaatagtaaatacttttgtgcctgccacagttctttttattttccaggaccaaataagacaaatgcatgtgaattggtttggagaagatttcagattaatcttcaaagtaagattgcaccttaatgaacccatcttcggggtaatttgagagtatatcttaccaatacggagtttaaatttaatctaaaattttgttctccattctgttcccagttttcttctctttaataaacaaatcactggactacatggtagaaaagctggtttctgaggacattctgtcctggaatatcatttgattcagaagctctcaatttgaaacaatttttagttgtgaccaaaagtatatatttgaacaggttaataagcatttaaataagtttaaaatcaaggtttcaatttcaaacaaaaacagatgagttattaactgaagcaaaatatgtagatttctaaagctgataaaagctctaatttaagaaaattaatattaagaaaatatttcaaaacatatactttttaaaatggcatattagagaatatttgttcatgtttaaaagatttatttattttaacaacaaaacacagctttaatcacaaagtatagttattttttaacaactttattgagatacaatttacataccataaagttcactcatttaaatgtacaatttaatgggttttaatatatttacaaagttttccaaccatcaccataatctgttttagaacatttttattgtcccagaaagaaatgtaccaattagcagtcactcctcattctccctgactccagccctcagcaacaagtaatatactttctgcctctaaagaattgagtagttcatgtaagtgggcttttttcaaaaccaccacatgctgtatgaactcaaggacatagtactaagggcttctttccctgatcacaatgtctttgagttccattcatgttgcagcatgtatcagtacttaaatcctttaaattaccaaataatattccattgtgtggatgtaccacatttgtgtacccagccatcagttgaaattttagccactgaagaagtgcaaacaaaaccacaagataacactacatatccactaaatgactatatttaaaaagacaggcaatagcaagtgttgggaacatgtggaaaaactggattcttcatgctttgttggcaagaacgtaaaattatacaacctctttgtaaaagagtatagcagttcttcagaacgttacctacccagttaccataccatcctcaactccactcccagtgtacgttcaagagatacgaaaacgtacgtccacataaagacatgtacatgaatgtttgtagcaacaccatgcatattagtgaacatttattttacacgccttttttacaaacatatttctaatataaaatttgatatgtctaaattctatgcaacttaccaaatatcccatgtgacagaatatgtttcagggaagctttggagaggtatattgtgatataacatagcctggtatcaattatcagtttcttgaagaacaaacagctttttctcttgcttgtttttgttttgattttaaatctcatcagggaagcatcattaaagtagaatttctattttctgaaaaagccctcatcagccattattaagtagaatggtgtcactaaatatgacaacataaagaagcatgttactattattattattttgatgagagagtactttgtctttgatactttagccagagttacattcttcatcttcagagagctcccctcttgattttagtgccctagtaggtcaccaagtcagcaagctctgaagacatctaagttgcctacacgtttttcatttcttgcttattttcacttcgtttctcacagccattgctctatctgcctttgtgtgttgcttgagcaaggctgcaggcttcttaaagattgcattccaatgactctgctttctccttatgtctacctcagggtcagggcgttccaaggtcaggaagaaaagggaggaataattgtatactgaaaaatataaacagacctgttttgctggggtactcagaaataaggtaaggaggtgccgctgcagagagcagaaatgggtaaattccatcggtccatttcatccacagtttaacctcttcctgatcagatcagtcagttcccactgcttttcgtttttagtgaagcacagttttacaagacgatcttagggacttgggacataaaacttgaaaagcattctcaatggtaaaaattacatgcatttttgtgaatgtgtcagtcactccttccttgtaccctacacgtgcctagactagtgccaggcacacagcagtttctcaatacatgtctttaaaacttatgaactccaaaaatgaggagaaaagctgaagctggagacaggaacatattctgcaagtcctaggattaaaataggagagtgaagtgatcgggtttgggtttcagaaggaattctcctgtctcagtgttgaagatgggttggagaagaacaaaggtaagaccatctatgtagagaaaatgcactttttgcctaaaccagaggaataaggaggaagaggtggcattctacagatgtgaaggcaatttatctgtgaagctgagggactcgggatgtggagggagaaagggagggaagcacccaagattgttgtgcaggagctaagcttagctggggaccacgggaggcgcctttacctggggcgggaccttccttaggtgggggttgaggaagaagcggccaggcttggcttccatcgaggtttctgtatctgggtgatacctggtgatgtgtcgacaggcagtgggttaagaaggcctcaatttcaggaaaggactatggcctggtcacatacattagcgagctgtctacatagaggtggcagtttacatcttgagaatggttgcttccaggaaaagagtataggatgagaaaagcagtaggaatgaagaatgaaagccccgcctcaggcgtgggtgaaaccttttaccataaccagaggtgctgggccattgggaaaatgtgtcattattaataaagcttccgccacccctcttctgggttgaatttttccccccatcaaacatcctatgttgaggtcctaacccccaacacctcagaatggggccctgtttggaaagaggttccttagaggtaatcagtcaagacgacgtcacactggagtaggatgggcccctaatctaacacgactgtgttcttataaaaagaaggccaggtgaagaagccgacacacaggagaacgctgcatggagactggagttctgctgccaaggaatcggtggaagccaggaaagagcctgcaacagatccttccgccgcacctccagaagaagcacagccctggggactgctggatcttacacttctggcttccagaacagtgagtcaatacatttctgttgttttagcggctcagtttgcggtcctttgttgtgccgactccaggaaactggacaatccccatgccgtgcaaagcaaacgttatattctaaccttcagtaatacaccctctcccaagtcctgacatttttctttttctttgatctttgctccctgattctcagaggttcctggatgggcaggtcattccgtgtgtactcaccaatccaggcccacaccccagtgccccgagactcaaattacaccagcaactctcagccacttcaaagaacctagtctgtccatatatggctcttaagtttttaggtttcagccctgcctgaaataagtgaagtaatatcattgtcctcaatttcctcatatggtgcttagattgcaagatcatttccagctcaaagtttctaaaagagttgaattgaaaatatttctcagaaggatgaggaggagtggcccaatcccttccctcacctcatcccttcttatcacgaaacttcctgggcttttatctgggcaagggtaggagccttcgtgtgacattaacaggtaaatccttggatttttggccatatctttaagcctttcctatagacctcttaaatacgaaattcccacaactggaatatataccgcattgatactatcttcccctttatcctaaaactgtcatctttaagcttcaaacagtactgtgatttgatgttaaccatgatgatttgtacaaccgtatttacaaggccacaactcaagtcatttttagatttcatccttctagactgtagccaaattcccatccataaagcctatctgattcttatttcagtgtactcctctttctctaccatcagtattggattattcgtcaattgcatttgtattctcaccttttctaactatactgctctaacttacaatttcaaattcaattttttttcataaagccactaaccacctaattaaacaaacaaacatcccattatagccttagaatctgcagctcaccctggtaagccctgcaccagactaatggtgttatcagcatgtcttaaatactgttatctaaatgttattgaaactgtatcacatgtcaacttgggaaaaaatgttgtgcatatttttgagataagaccactaagctggtccaaggaatatatgtgtgagtaacatttctcactgttttttttttaatttaatgtcattactatagcagcgaaatgcacaatacataaaaatattaatattctgccacgaagtaaaactatattgtcattttcatacctattagtaattcaagagaaaaaggtctgttcttctcaatcttagctttgataaaaattataaatatatttttaaaacaatatatattgtttaattaaaataaataaacaatatattgcactctttcatccaccaagcacaaagcaggttctgataaaaaacaaaatattattaattagttatccaaaagcatagttaatagtgtagaaccctgtttttaattcagcatttttatatgtaagagtttcatagttaataggaattggccattttataaatggttggtgacagcatcatactgaatgggatgcgattcttatggtatatgacaatagtctattccttcaaagggagaggtgacagggaggttaattaacctttcatcagttaagagtcctttatcgatgaggatgtaaagagaaattcatctcaaaacaatagtttgtgggtacgggttgttttacccattttctagataaaaggagctgaatttcatatccaaaatctagttgcagccacctacagccaagttaaccacatcgtcccatttctgctgatcagaaaggaagcctctagcaaaccatctatattaatgcaaagaacaactttctatccaaataatctgaatttaaatttagcagatttttaaattaataagcttttgactttattgttactgagattctaccttattgcaaactgggtttctttccaattctaaggagacagttattcttcttttttttttttttttttttttttgggacagagtctcgctctgttgccccaggctggagtgcagtggtacaatctccacttactgcaacctttgcctcatggattcaagcgattctcctgcctcagcttcctgagtaactgggattacaggcgcaggccaccacacctggctaattttttatatttttggtagagacggggtttcaccatgttggccaggctggtcttgaactcctgatctcaagtgatccacctgtctcggcctcccaaagtgctgggattacaggtgtgagccaccatgcccagcctcagaatggtttcttttagctgcttttagtaaagtgcaagagagaaactctgccttgcccctctcacatatgcgcgtgcacacacacacacacacacagaggcaggcaggcccacattagcacccatgagtagggaactgtagacttttcgttgtcttctttataaatcaatgggatgtaatgaatattttttctgatggctaaggccttatagctatattaatgggattatggcgccatcatgtggtaatatgacatttttaaaaattattttttactggctgggtgcagtggctcaagcctgaaatcacagcactttgggaggccgaggcgagcggatcatgaggtcaggagttcaagactagcctggccaacatggtgaaaccccgtctctactaaagataaaaaaaaatagctgggcatggtggcgcgcacctgtaatcccagctacttgggaggctgaagcaggagaatcacttgaaccggggaggccgaggttgcagtgagccgagatcgtgccattgcactccagcctgggcaacaggctgagactccgtctcaaaaatatatatatttttaaattatgaaatacttaaaatgtactaaaaagtacagaaataataacaaatacttgtgtacccaagtttacgatattactttatatatttttctaaattaaagaaataatcttcacaaatacacagatactatcccatctctccattctcagaagtaactactgacttctgagtattagttttgtttcttatgtaaatatgtataattcataatcactatgaaccattattttatcagttgaaatgtctacaacacatatggcatcattctattgagatacacattggcagatatatgtgtgtgtatgtatatatattctcttgcaatttgtggtattcacttaatggtaggttttgaagttttatctatttatatttgtagttctagttcttttttaacaacagtatagtagtaatacatctctttgaacaggacagtgaagttgattccatttgctcaatatgataaattgcactgcaaagaacattcttttacatgtcacagtgtataggtttcctctggagttaaaactttggcatgaaattgctttccaaacctgatgctcctgtctgtgtttgtaatgcctttgcaggcattaaaacacctcagctacaaggttgaatcaatgaggtgaaaacagaaagctttctcttgtgttcttgacgttaaagcgttgtttctatttcatcatggtgtgtaacgtttgctattgtttattatgcgtaccatttagcaggttaagaaaattcccttcccttccaaatattctaacagttttatcttgaataaatactattttaaaatgcacttttatatctattggaatggaatcaaacgtgattcctttttgacaatttttatgtgcttgaagtaaagggatattttacatgcactcagttaaaaaacaaaaacaataacaaaaacaaaaaacatttaaacaggatttcccccctccccagacgataaatggagtttttgctctatatctttgctaggctcaacatattttgaaatatgctttgtactgggtgtgagacgagccactttcattatgcctgccacagttgagcaagtataaatatgtaggtttctgttctcgtagccctttatttgtatatataaaatattacaaacactatacatctgggataattatcttggctagtcaattaacaagaaagccagatctatattctcctgacacaactggtttattattgcctttacttctacaacttcccctttgttaactctaagctctttaaggataaggagcttggttacttcatattctcacacagcttactgccaggcatgtagtagatctctacaaatgtttgtggaaagaatcaatgaccagcatcagggagaatcttgcttttattagtatttgagttattatttttgagacaaacacattatagcccctattttgttgggcataaattgattcaacaataatgaacagagagaagtttaatacacagaaagtgcaatggagttgcagtgtgagaggtttacatttttgtttgaacttcaagaaggagatatttaaggattaaaacctggaattggaaaatgaaaaggaaaaatgctattaaaaattagcaaaattttataaagaattttataaagaaacaaaattaacatctcaatgtaaaatatatcaccattgaaatttaaaactcggtaaacagtgggcatcttaattagacactgttgaagatcgaaacaaggagctgaacaacatgtagaagaaactaaccgtaatgcacagcatagatagagatggaaaacatggaggagaggttaagacacatgaagtacaaaataaggtccaggatatggtttacagaacctttaatataaaagaactgagaaacaggagtacagcaatatttcaagatataatgactaagagttttccaaattaaatggaataaatgaatcctcagcttcaaaaacaaaacaaataccaagagaaataaatgttcaaacatctcccatttcagacgaattttagaactgtaaaatccctcccctcaaaaattaaactccaaattacctataaaaatggctactaaaaacgataagctagaaaataccagaataacatcttccaagttctaaaaggaactgctataaatccagagatttgtattcagttaaactctcattgaagaacaacagagaaataaatagttttcagacaaactgcaaaaaatgtcatgaggacatgtcatgaaatgaacttctgaaggatgtattccagaaagaacaaaatcacaccgagaaaaattacacaaatttcaaaactgaaagtaagcaagattctgggaaacaggaaggtcaatctcgacaaacacaattttcatcaaaagagaagaatgtccaagaaaaggtgactaaaaaagtaagtgcaatgggaaaaagatctgaacagacacctccccaaagaagatagactgatggcaaacaggcataaacccatgaaaagatgctcaacatcatgtgttattagggaattgtaaattaacacaacaatgagataccacaacacacatactacaataactaaaatccaaaatactgacaacaccaaatgctggtgaaggtgtggaacaacaggaactctcattcattgctggtgggaatgcaaaatggttcggttcccttttatttgacatggataccaccatgaacacctgaatgctacctgtggtagcactgaagccttcgtgccgtatgttttttcctgtacagcaacgggcaggtagcatatacagtatagatccaccacacaaagggatgatcacattgcaaacagaatggagtagggtgacatgaggaacaagatgtttaagggatagataaagagatagataagtagatacaaatatagactgtgaaatgattgtcaagctaattaacacttcatctacttttttttttgtagtaagaacatttaaaatctattcttttagatttctcaaagaacttaaaacagagctaccattcaatccaggattcccactactgggtatatatccaaaagaaaataaattgttctacccaaaagacacaggctctcatatgttcatcacagacatgttcattgcagcactattcacaatagcaaaatcatggaatcaacctaggtgtccatcgagggtggatttaataaagaaaatgtggtacaaatacaccatggaatactacacagccacaaaaaagaatgaaatcatgttttttgcagcaacatagatgcagctggagggcactatcctaagctgattaaggtaggaacagaaaagcaagtaccacacgttcttacttagaggtggaagctaaacatttggtactggcagatgtaaagtgttcagcaatggacactggaggctgctgctggtggaggaggcaaaagaggggaagagttgaataattaactgttgggtactatgctcactacctgggtgacaggatcaataataccccaaaccttaatatcacacaatatgcccatataacaaacctgcacatgtacccctgaatctaaaataaaagttgaaattattaaaacatcttctctttaagcaattttgaaatatgcaaacattattattaactatagtcaccaggatgtgcaatacatcactgaaacttaaccttcctgttcaacttaaactttatatcatttggctgacatctcttttttccccatccacaacctcccctactccagcccctggtaatcaccattctactctgattctatgagttcaacggttttagattccacatataaatgagaccatgtggtatctgtctgtctttggctggcttatttcacttaccataatggtttccagtttcattcatgttgttgcaaatgacaaaattaccttctttttaaagtctgaataccattgcattgtgtgtaccacattttctttacccattcatccaataatggacactttttttcctatcttggctattgtgctatgaacatggcagtacaaatatttctttgacatactaatttcaatttctttggatatatacccagcagtgagattgctggatcatatggtggttctatttttaattttttgaggaactgccacactgttttccataatgactgtactaatttaaattcccactgacagtgtactttggttcttttctccatatacttggcaacacttgctatgttttgtctttttgacaatagccaatctaacaagtatgaggtgtgagttaatatctcacagtgggttttatctgcagctgcctgatgattcacgatgggcattttttcatatatctgttggctatttgtgtgtcttcttttgagaaatgtctgttcatgtcctttgccccttttttgatcaagttgtgtttttgctattgagttgtttgagctcctgaaattcttttatgagcttaaaatttgtatggttgggcatgggggctgtggagctaggattgctttgcaatcatctgtccaatgttctcatgcttttcctagatgtgttcctcattgagtaaccagccacgcacacaccatttccctcccagatgatgaccaaattcaggaatggccgtagccccagcttccgcattttagttcccaatggtttcacttcctcagcttctgcccatggatgccctgcctcctaatatttacacacgtcatagggcacagaagtatggacagaagtctagctctaattccaagatagaactggatttcccatacattctcagtttatacatgtatgctggactctaataatgaggttatgcttaacgaaatacaaccaaattacaggcaaatactgttgaatgaaagagtcttttaaaatcattatttatagcatgtcttacctctggaagttagctggtcttttttctgttttttcaagcagatacaaagatgttgccaccagagagcaccatggtactgccttaatctttatatgtcactttttcattaatccctcatttcaggggtgacaaataatagcgacgataatttaagccaaatttggaaaattctttcattctatttctgaatttaaaaatcaattatgaaaacattttaaaattgtgtttttaaacatcctaacataaaaatttttaaacagttttgctaaaaattgattctggtgattcaatgttaattatgttttacataggtaagttcatatgccatctatttgctgattctcatgagatgtttgtgctaataatttgtgggttttgttactttaagttaggtttagtgtaaaagtctaggttcatcctatttatgaatcttgagaattgctgatgtgtctttgaatattgtttcagaattatgccattcttttactgaatacacatttatgcctatctttcccctttcctcatctgcgactcagtaaataatatctaagggtaccttcagatctaattgtctattattttacaccaacatcttcagaatgcactagccagaaaatactgcttcagtgatacaaaacatgaacaatgtctgtgtgagtgaaattggactgtgcaattatgttctcttttataaccctgatgatgtttctaaaataaagcttgtatgctcagactccccaaaggagtaaacatactagagtttcttcatcctttgaatgatcataattagataaaataggcaccagtgtttccattgtgtgatatatgcttcatactccattttctgaagtgcctgacaatacaaaattgtgtctgtatgatcaaactttgtgtttggtcaagtatggtattaccagtgtgcttatcaagcttaatcagaaggcattacctgaataacgttttatgatatgtaaaaaatacagtctcatatgataaatataagctacccctcaagacatacaaaataattcactgctagttttgaaagctatgacttcaaattaaaatgtgtagaaaatactccttattacagctcttcctgtactggctctaaagaaataatccaataatctattgattattttcctcatagacattcctttaacaatgtaaagcttctgtatttgggttttgtttctggtagggggagcaaaattgtgaaagggacacaagaaaatgtcaatagtttatatgaaagaaatgcaaattttatgatttaaaataacagaagacatgctatcacggggaagggggcatctgtcactatagctctaaaattatatgtctctgatgttcagttaaatggaatatttgtgcttcaggaaactttaatttgggttaaacctgtggccatattatcaatatatatgagccttccttattggcttctggtggtgattaaatgagaaaggtaagggataaagttctctccagattcatttaaacgactgtctcaaaaactgctctccagagcactactccaggaagagatcagggcgttttccacagaaaaaaaactgatttggtgatcagaaaagtatagaaaagcccacttaacatatctccttcctaaagattcacaatgaacattattatttaagagctttttgaagtgcaaatccatgagctttttaaccctgagcaattgctaccaagctaactctgaaatttactgcttttagtcaaaatacactcttcagctaatgctttcttccagctggctgtcttcttgcctgccctgtgtcgtaaaatgggggtcccttactgcattatcaaggggaaggcaagactggaatatctagtccacaggaagacctacaccactgtcaccttcacacaagtgaagtcagaagacaaaggcgctttggctaagctggtggaagccatcaggaccaattacaacgacagatactgtgagatccgccgtcactgaggcagcaatgtcctgggtcccaagtctgtggctcgtatcgccaagctcaaaaaggcaaaggctaaagaacttgccagtaaactgggttaaatgtacactgtcgagttttctgtacataaaaataattaaaatacaaattttccttcaaaacaaagcaacaaaaacaaaaaaaagagctttgagaaattctggaataaagagacatgatggaaattttttaatacactgttgccaatctgtaagaccataaaggctgggcacggtggctcaggactgtaatcccagcactttgagaagccgaggcaggcagatcatgaggtcagaagatcaagaccttcctggccaacatggtgaaatcccgtcttgactaaaaatacaaaaattagctgggcatggtggcacgcacctgtagtcccagctactcaggaggctgaggcaggagaatcacttgaacccaggaggcgaaggttgcagtgagccgagattgcaccactgcactccagcctggcgacagagggagactccgtgtcagacactggaagactccgtctcaaaagaaaaaaagacggacgggcgctgtggctcacgtctgtaatcccagcactttgggaggctgaggcaggcaagatcacctgaggtcaggagttcacgaccagcctagccaacgtggtgaaaccccatctctactaaaaatacaaaaaattagccgggtttggtggcacacacctgtaatcccacctattcgggaggctgaggcaggagaatcgcttgaaccagggaagcggaggttgcagtgacccgagatcacgccactgcactccagcctgggcaacaagagcaaaactccatatcaaaaaaaaaaaaaaaaaaaaaaaaaaaaaaaaaaacaactgagaaatggaaatccaggtttgccacttaccagctgagtgatcttggataagatatctcaattctctggctcttcttgacattaaattatgtaacacataatgctaaaggtacataggaaacatggaatagatattaggggggtttttaaccttctgtcttaacatgcttttaaatcctatagttttatagagcatgtgttctagtaaattagttgctaatttatgtttctattcaagaaaatcatttgctttcatgcacccagttctatggtgggcaccttgtgttcttgactacctgtcatccatccctctctctttccaaaagtaccctgatttattattcaggcattaacttttctacagtatagcctctgcatgtccagggaaatgtgcccaccccaagcttggaggttggctgtaggggttgatttaggaaaaggtaatgatgcaaatgagatcgatgtgactcaggagagtgctcctgtgtgcccttcctagccagggtgtagacggggtgctgtcctgtgtggggcattctccgtctgcctatccacatccgttctccaccctgcccctctaggctttatgtgttgaaaactatcttctgtggatttcgtcatgtacactccccagatctcttgtttggggatgattttggctaatggaagacactgcaacagaatatatagcaaaagaaaataatggctgtctttcatctttctctcccctcgactgtctcacagcatgttattgtgtagacctacatagcctctcctattaacttcaagactttcagaggctatgacgggaaaagaattgacatggcaaattcaaaatttctttttgtattctgaaagcaaagtaaagtcttagagctgactcctatcaattacttttatttcatcacatgaataaatgaataagaatataaaaaaattaatggagaataaacaaatatataaataaatgagaataagataattgaagatgctgtgatcatgtggcattccatttgttgtggagggacacacacagatgaggagtggacagttttaactggatggggacagagatgtccaggaaagtggtttcataaaggagatttcaattaagctcatttttcagaaataaatattttcaaagaacacaaagaggaaaaggaaattactagcaagtgattgttcaactgcttaataaaaattacagttctgaaacaaacatattttgagaaactttatgtagttcattacggttgaaatactgagtctgaagcatcagaaacagggcaagagacccgtcagaggcagaccagggcgcctcccagccaggccttttccacaacatgagagaagtgggcttcatccttctgtcagagggtttgtgtttatgaatgttaggcaagaggtaaatatgaccagtgctgtaccttttttttctttttgagaaagggcctcactctgttgcccaggctggagtgcagtggcgcaatcttggctcgctgcagccttgaactcccgggctcaagcaatcctcctgcttcagtctcctgagtagaaaggagcacgcaggtggaagagtacactgacagacaccagcaggccagtaggccatcgatgggtggaacgaggcagagtttgcagggagcagtgggagaagagtcgagggaaaatcatctcccttctggcttcccccgtctgctgagagtgacttccgctcaataaaaccttgcactcattctccaagtctatttgtgatctgattcttcaggtacatcaagacaagaacctctgcctcccaggttcaagcgattctcctgccttagcctcccgagtagctgggactacaggtgcctgccaccacacacggctaactttttgtatttttttttagtagagatggggtttcactgtgttagccaggatggtccccatctcctgacctcgtgatccgcccacctcagcctcccaaagtgctgggattacagacgtgagccatcgtgcctggcctaggttttttttagaatttcccaagatggtttaaaatttatatggaaatggaaataatgtagaatagccaatgtaatcttgacaaagaacaacatagaggaagagctccataacattggtctcagcaacgattttttgaagacgacctcaaaagcacagcaaaagcaaaaatagacaaatggggttacatcaaactgaaaagattttccacagtcagggaaacaactgcagagtaaacagataacctacaaaatgggggaaaatattgcaaatcatacatctgataagtggttcttatctaaaatacataaggaactcaagtcagcaaggaaagaaataccccagttaaaaaatgggcaaaggacctgaatgcatatttcctgaaagaagacatacgaatggccagtggttatatgaaaatatgctcaacatcactaatcatcaagcaaatgtaaattaaaaccataatagaataccgcttcacacctgttagaatagctattaccaaaaagatgagataacaagtgttggcgaggatgctgagaaaagggtatccttgcacactgttggtaggaatgtaagttgatacagctgttatgaaaaaccatatggagtttcctcaaaaaaattaaaaacagaactaccatgtgatgcagaaatcccaacactgattatataaccaaagaaaatagaatcagtatgccaaaaatatatgtgcactgcatgttcattccagcattattcacagtagccaaggtatggaaacaacataaacaacataagtatccatcaatgaatgcatggataaagaaatgtggaatatacacgcaacataatgttagccttaaaaaagaagaaaatcctgtcatttgtgacaacatggataaaactgaaagacactatgttaaatgaaataagccagacacaaaaaaatactgcttgatctcacttctatgtggaatctaaaaaagctgaactcagatgtagaaaatagaaggagattagcaagggttggggtttggggagaggttggggtgatgctggtcaaaggatacaaaatttcagttaggaagaataaggtcaagagacctattgtacaagattgtgactatagtcaatattgtgttgtattttttaaaattactaagaattgctagattttaagtgtcctcaccacaaaataaaatgtgaggtaatgcacatgttaattagctcaatttagccattcaaaaatgtgtgtatatatatatatatatttcaaaacatcatgttgtacataattatatacaattttgtcaattaaaaataaataagtaaataagaaatgtgtaccaaaaaacaggaagaaagaacaaagggtgtacactatctgatttcaagacatactataaagctaccctagtcaggacagtgtgacactggaataaagatggacaagtatagttcaatggagcagaatatacagtgcagaagtaaattcacacttatgaggttaactaatttccaacaaaggctgatttccaacaaaggcactgaaataattcaatgagcaaagggaaatctttttaataaatactttggaaaaaatgaatagctacaagggaaagctaaaataaaattcaacctctatctcacagagtatacaaaagttaattcaagatggatcacaaacccaacataataactaaaactttaacattttgagggggaaaaaaacatgagagaagttctttgtagccaaatagatatttcttggactcaacacagaaattactaattataaaggcaaaataattacaagttggattacattcaaataaaaaagcttctgttaatcaaaaaacatactcctaagaaaatgagtaggcaagtaacagagaaaatgggagaaaatgtatgcaaaacatttatctgacaaagaactgttatcccaaatacacaaaagatagctacaactccgtgaaaaagataaacaacccaattttaaaatatgcaaaagactcgataaacactttaaaatggaagacatacaaatagccaaaacgcatatgaaaagatagtcaacattattcatcatttgaaaaatgcatataaaagcacgatataccactatgctaccagaatgtagaaaattgaaaaaaaaacaacaggggctgtatgtagagcaaacagcaatctcatacattaatagttgttatatgaaaatagtacagccactttgaaaacatttgtggcagtgtcttataaaataaacctttacctatactctggcccgacaactccacaccgaaatatttcgcaaaaaaaaagtatgttaacaaagcttgaacaacaagatttatagcaactttatttattatgtctcaaacaactaaaatgttcattaaccagagatcagattttaaagttgtagtacatttctattttttttttttttttttttttgagactaagtgtcgctcttgtaccccaggctggagtgcaatggcgcaatctcagctcactgcaacaaacgcctcccaggttcaagcgattctcttgcctcagccgcccaagtagctgggattacatgtgcctgccaccacacttggctaatttttgtattttttatttacttatttatttttagacggagttttgctcttgttgcccaggctggagtgcaacggcgcaatctcggctcaccgcaatctcggctcaccgcaacctccacctcctgggttcaagtgattctcctgtctcagcgtccctagtagctgggactacaggcatgcgccaacacgcccgactaattttgtatttttagtagagatggggtttctccatgttggtcaggctggtcttgaactcccaacctcaggtgatccgcctgcctcagcctcccaaaatgttgggattacaggcatgagccactgtgcccggcctcctaatttttgtatttttagtagagacgaggtttcaccatgttggccaggctggtcttgaactcctgacctcaggtgatccacctgccttgacctcccaaagtgctgggattacaggcatgagccatcgcgcctggccaaaattgttgtacatttctagaatggaatattaccaaagaagaaatactattgctacatgcaacaatatagatttaacaagctacacacacaaatatgatgctagctacctgaaattctaggttataaaaaactatggttaaaaaaaccagaaattgtgttttgctcttgagagaaggaattaactggggagaggctcgagaaacatcctgtaatgatagaaaatttctatatcttggttaagataataaacaaacaaccccattaaaaagtggacaaaggacatgaacaaacacttttcaaaagatgatatacaagtggccaaaaagcatatgaaaaaagctcatcatcactaactattagagaaatgcaaatcaaaaccacaataagataccatctcacaccagtcagaatgactattattaaaaagtcaaagaataacagatgctggtgaggttgcagagaaagggaagacttatacactactggtgggagtgtaattagttcaactattgtgggaagcagtgtggtgactcctcaagtaactaacaagagaactaccattcaactgagcaatcctactattgtgtatattcaaaagaatacaaattgttctaccataaagacacatgcatgcatatgttcactgcagcactattcataatagcaaagacatagaatcaacccaaatgcccatccgtggtagaatgaataaagaaaatgtggaaaatataaatcaatactatgcagccataaaaaagaacgagattatatcctttgtaggaacatggatggagctggaggccattatccttagcaagctaacacaggaacagaaaaccacataccacatgttctcacttataagcaggagctaaatgatgagaactcatggacacatagaggggaacaacagatactggggcctatcagagggcagagggtgggaggagggagaggttcaggacaaataactagtgggtgctaggcttaagaccagggtgatgaaacactctgtacaacaacccctgtgacataagttcacctgtataacaaacctacacatgtacccctgaacttaaaataaaagttaacaaataaagataggaatgtgggttacagaagtatatgtacttgtcaaaactcttaattgcaacttttagatctgttaagtttcactgtatgaaaattttagttcagaataaaagaattctacacaacattgacctttacacagtagtttatctttctggtatggcaattctgaaatttctttctgtgtacttgatgattgagtaaatgaatgcgtatattggggaaattgggagtcaggttggttactgatggagagggggaaaggtgaaaatgcaacctatggtgttgatttggaactgaggacataagcctgaatacatactttataataggtaaatgaaagatagataatgatagacaaatcaactagatagatagatgatagattagatagatatagacagaataatagatttagttgtatttctgagctctgtatgttgagagtacctagaagcaacggctctttgaaagcaatgaacacactagtcacactagtactagtaccttagtaaaagattctccatgacatgagaaaattctctacaatgaggagccagaagttaatacaaagaatagcacaggaaaagtactgaatgagtctggaagatcttcttgtgttataaagtaatagagaagtcaaaagtatgatagacatatatcaaaagggcacaggcaccagcttgaagggctcacattggtcaaatctaaaataagtaaataataattgtaatagattataactctttaaataagtatttatgatcccattctgatgtaataaaataactaagtaggtcttactagcaccttaatattgaactttccagcctccagaactgtgagcaataaatttctattgcttataaatttttttaaaaaaagatttcagcctactttcatctttgcaacgtgatcatttttaccattattcaaataaaaatgttcccgtctattataaaaagaaaatgactaagtaaataaacagaaggtaatgccaacaaataaatgcacaataatggcgttagaaaaatcatcagcgggtgctaacagcagtggataaagtttgatgtggaacagggtatttacatagtcttaaagtgtctcctaataacttacttatctattacaagaggaaaaaccgtaactttccaatggagagactttattgaccataccttaatcaaaaaatcaaacttaacatcagccacattagtacaaagtgacattacacatttcttgacgatatactgagaagaacagagaataatttctatggcattcctgtgaaaagaatcaaaagacctgaatttgtgaaaagtgtcaaggtcaagaaagaaaaaaaatgtctgaggaactgtctgagttaaaggagactgaatgcaattgaaggtgacttaatgcaatgcttaactctggaccgggaacaaaatagctacagaggacattgaacagctgatgaaatttgaaaatagactgtcaattaaatgtcctgatttttataagtgttttttgattatataagatgtacctttgttcttaggaaatgtgtgctaaatatttcaatgataaaaggagcacagtatcttcaattgactaagaagtggtttaggaaaaataaatagttaactgtatattatataactctatatattatgtatattatctattatgtatatgtagagaaatacatataaaataaagacctataaataattgttactaagtgtatatatatatgtgtgtgtgtatgtgttccttgtactattcttgaaatttccccatatctgaaattacgtaaaatagtgataaaaaagaatactcattgacagatggtaaatgggaaatgcatcaaaaattgtatcttccctatcataatttctcaaatttgtgtagatgagaaaattgcaaattgtccaaagatactgacagtgagtgaaggtgtctgaaataaacagcataggtataaaaggtggctgaaagatcaacactttcctgttcaaaaatgacaagcaatctattgtgcaaagcttcctgcatggtaaaatggattttaaatgtcctaacatcacatattttcataaagagcactctggcccatagagctgcttgctatatgactactagagatacgaaagaatttacttcttactgcacttgataaaatgacaggaaatgacaatttaaaaataagattgtcattttgtttcaattttcaatccaagaaaactctttattttcaccccatgcctatgaatgcttggaagaaaatgtgtcaagacttcgtactaacacagttagaatgcaaccttttgacttatatcttttcccctattatagaaaattcctggcataagtcacttacttgagttctgctctgagtgataagatgcccttggcagcttgaagactgtgagatgataggctataaaacactgaatctgggaaggacattgttgggtaaatactgtgttatgaatttgtgcttggggctgagccaaatgtggaaggacgccagtctacagctcagtcagtattagtgacatccaacaagctggggaaacagcattccatgaccatcaaagtagcagcaggcacaacgttagtgaagaagcattctagtgttttgttttgttttgttttaatacatattatagtgagagtagggaaataatggagaaattagctcacatgagcactgtggcatatttcattttgtttttcatactaacccagggaaatagaaataatcatacttttttttttataaaagtgacaatagattcaacgaggttaagcgtatcactgaagctgcacagttattgtggaatggagtcgggattcaaatctattctgctgttccacgccaaagcctacgttcaatccctatgccacagtgcatcctccaagagacgcagtgatagtcttaactctccctcagaaaaaaatgttgaaaaagaaaaacagctgacacaattttcttacttcttttcctctgaggtcttgtcttaggcaagctgccattacttcgaattgggaagcgactctcctgaaggtgccaggaaagttcacgtgtgaagggtgaaggggtggcctgcccctccacacttgtgggcgtttctcatcaggtggaacgagacttgagaaaagaaagagacacggagacaaagtatagagaaagaaaagtggacccggggaactggcgctcagcatacagaggacccgcgccagcaccagtctttgagttcccttagtatttattgatcgttatcaggcgtttctcggaaaggggaatgtggcaggacaataggggaatagtggggagagggtcagcaggaaaacatgtgaacaaatgtctctgcctcataaacaaggtaaagaaaaaagtgctgtgcttttgatgtgcatatacataaacatctcaatgccttaaagagcagtattgctgccagcatatcccacctccagccctaagcggttttcccctatctcagtagatggaatatacaattgggctttacaccgagacattccattgcccagggacgagcaggagacagatgccttcctcttatctcaactgcaaagaggccttccttcctcttctattaatcctcctcagcacagaccgtttatgggtgtcgagctgggggatggtcaggtctttcccttcccacgaggccatatttcagactatcacatggggagaaaccttagacaatacctggctttcctaggcagaggtccctgcgggcttccgcagtgtttgtgtctctgggtacttgagattagggagtggtgatgactcttaaggagcatgctgccttcaagcatctgtttaacaaagcacatcctgcacagcccttaatccatttaaccctgagttgacacagcacatgtttcagggagcacagcattggcggtagggttacagattaacagcatctcaaggcagaagaatttgtcttagtacagaacaaaatggagtctcttatgtctacttctctctacatagacacagtaacagtctgatctctctttcttttccccacacacgtggcagggagcgtagccaaggtcaccgggggcagagtgtcattacccatggatattccagcctgaagtgctgctagtttcaatgccaggcctacactggcgcggataaaataaagtgcaattttaactctgccgacaaagagctcttccctcttctaaataaaaacatagctcgtttgggattcaagtaaaggtgagaaatagaaaagtacccagtaagatttacaggtaaggaaaataaagtttttcaataggagttaagctactaaaatttacacagaatcaatgagaaaaagccattgaatacctacagtaatactagccaccatttcttaaccacctgttaggtagtggccataaaactcaacattttacacattatctcatcacattcagtcctcatagtgatcttttttttttttttttttttttttgagacggagtcttgctcaggcaccaggctggagtgcaatggcatgatctcggctcaccgcaacccccacctcctggattcaagccattgtccagcctcagcctcccaagtagctgggattacaggcatgtgccaccacacccagctaatttttttttttttttttttttagtagagacggagtttcaccatgttggccaggatggtcttgatctcctgacctcatgatccacctgcctcagcctcccaaagtgctgggattacaggcatgagccaccatgcccggccctcatagtaatcttatgaggtaaattttattaattaaatttcacaaagcaaaatgaggtttagaaaaaaataattaacttggccaaattccacagctggtaagcaggccatattcaaacctaggctggcaaacaccaaagtctttgctctcacctctaggctgtgttggctgtaaatgtgctaccaaagtgttgggagaacctcagatcttaatcatggtggcatccctggcaagtgactataatgtatgcagtagaaatacaatctacactattttacctatggggaaaaacaatatgaaaaagagaattatcacactattgaatagaaaagagcatccaaaaactgggtgttggcaatgttcactcgaaactgttccaagaagatgtagattgaccttgagattaaaaatttgtagcacatgaagaggagtcttctgttgtggaacaaaaatagttcatttggcatcatttcatagcttggtgaaatagctctcaaatgtattgactgttttttctctaattatataatcaccgagcaatattctgagtaaccaagaaatagtacagtgtgtataccattgtattttatgaaaacaaattatgcaatcagaagtagtgctttttttttttttgagtctcactcttgatcacccaggctggagtgcagtggcacaatcttggctcactgcaacctccgccttccaagttcaagctattcacctgcctcagcctcctgagtagctgggattacaggcgcccaccacctcgcctggctaatgtttgcacttttagtagagatggggttttgccatgttggccaggctggtctcaacttcctaacctcaggtgatccatccacttcagcctcccaaagtgctgggattacaggcatgagcaaccacgcccagccaagtagtgcaatttttaaaataaaattgaaatttatgtgcaaatgctgaaagatattaaatcttacaaaaatttaattcttaaagaaaaaggggtgattttaaaccttgccttgcctgtgtctttgctgtagatggaactaccttagttagaagcagaaaggcttcctgctccttttcaatattatcagatccatggtgctttttaaagacatcagcactttcttacagtgatttagggattatgatgcttttattttaatgttcattacaaatgcaatttaaaataattctatgtactatgataatattatccaaatattcattaagtggtagtggcagtataagaatacaaaaccagacttccaaatcaatgattcttagtaagataaaacaattttttaaaaaggaacatatgactgggtgcggtggctcatgcctgtaatcccagaactttgggatatcgaggcagatggatcacctgaggtcagaagttcgagactagcctggccaacatggcaaaaccccttctccactaaaaatacaaaaattagctggggttggtggtctgcgcctgtaatatcagctactcaagaggctgaggcagtggaatcccttggacctgggagatgtaggttgcagtgagctgcgatcacaccactatactccagcctgggagacaaagtgagattctgtctcaaaagaaaaaaaaaaaaaaaggaccatatacgtgtcggttaatgttagagacaatgttctgaaaataaagaaacagcattaaagaagcacacctgcagcaccttcgtgttggcaaagatcactgtacatcagccaaagataatgaaaaccttctcatggcatagctgcaaaataaacatcatagcaatattctcttatgctttgttttcagtagatttttaagctctgtaaaaagtattaaacttaacttgcatttgcttctatgtaaaagttactcttgggttacccaagttttgaattgtgaaggtttaaagtaggaattcccatcataaaataggacaatcatattttgatgcagagagacataccataccatagataggtgaaaaattattccagtcataagaaagaaaaacctcttttagaaattagtgaagtatttgtacctgatttataccttcttcatactttcatgtgatgtctgatcagctcttagaaactgaaaaaagaaatgattttaggaaatgccaccttaagagagctcttggatgaaggtcgcctgactggctgcatgccttgccttccctttttttttttttttttttgagacggagtctcgttctgttgccgaggttggagtgcagtggtgtgatctccgctcactgcaagctctgcctcccaggttcatatcattctcctgcctcagcctcccaagtagtcaggactacaggcgcccgccaccacgcctggctaattttttgtatttttagtagagatggggtttcaccgtgttagccaggatggtcttgatctcctgacctcacgatctgcccacctcggcctcccaaagtgctgggattacaggcgtgagccaccacgcctggccatgccttgccttcctttaagatgatagtccatccccaaacatgccagcactaaccttatgacaaagacaaacaacattccctttctactctaatttcataccatccattaaaactatttaatcacagagaaagaaaaaaattttaataaaacataacccttacagaccacaagagacagactaaaaccaacagtatatgggcaataatatagtattgtcttctggtggaaagtgtattgctggaaagcacattcctgaagctttttctactttctgtactttaccttcctatctaatttaggttttctgttgctaggaaagagatgcttctatccatgtgagaacagtatttacagctcttcaggaaattgttgccacttatataaaataccagtaacaatgacagaaaatattttcattttctcctggtgactttgttcccacttttacttcaataagactaccgttaatctaatttcagaaaaaaagggctgtagtggcctcatctaaaaattggagatgattgaaaagggcacatttgatttcatattttttattttttatttatttatttattgtttattttttgaggcagagtcttgctctgttgcccaggctggagtgcagtggcgcgatctcggctcactgcaacctctgcctcccaggttcaagcaattcttctgcctcagcctcccgagtagctgggactacaggtgtgtgccaccatgcctcgctaattttttgcattttaagtagagacggggtttcactgtgttagccaggatggtgtcgatctcctgacctcatgatacacccgcctcggcctcccaaggtgctgggattacaggcatcagccactgcacccagcctgttttcatattttttatttgacatattgtaagtttacatatttatggagtacaacttgatgttttggtatacatccatgttgtataatgatgaaatcagggtagttagtatacagatacctcaaatatgtaccatttatttgtgatgagaatatccaaagcctctcttctattttgtaatatacaatattttactgttaaccatagttaccctctggtgcaataggacaccagaatttactcatcctatcaaattgtaactttgtacctattcaccagcctctccatttctccttggcatccttttcccctctccaatctctagtagccactgtatactctctgcttctatgacatcaacgttttctttttgggaggattctacatataagtgagaccatatggtatttgtctttctgtgtctgccttacttcacgtaacattatctcctccagcttcatccatattgtcacagatggcaaggttttattctttcttatggctgaatagtattccattgcatatatataccacattatcaatttatctgtggatggacacttaggctgattctctatcttggctattgtaaatagtactgcaataaacatgggagtgtagatatctctttaatatactgattttatttccttttgatacatacctagtagtggaattgctggatcatatggtagttctatttttaattttttgaggagctgccatactgtttttctttttctttttctttttttgagatggtgtctcactctgtcttgttctgtctcccaggctggagtgcagtggaaagatctcagctcactgcaacctctgcctcctgggttcaagcaattctcctgcctcagcctcccaagtagctgggactacaggcgcccaccaccacgcccacctattttttgtatttttagtagagatggggtttcagcatgttggccaggatggtctcaatctctacactgtttctcataatgactgtattcgtttataatcccaccaataatatgcaagtgttcccttttcaccacgtgcttagcaacacttttcattgtttatctttttaatactagtcattctaactagagtgaggaggtatctcattttggttctgatttgtatttccctgattattaacggcattgagcacttttttaatatatctgttggtctttaaataagacctcaaaagcactggccacgaaagcaaaaatagacaaatgggattacatcaaactaaaaggattttgcacagcaaaggaaactactaacagagtgaagataacctacagaatgtgagaaaatatttacaaactatacatctgacaaggggttaatattcagaatatataaggaagctaaacaactcaataccaagaaaaaaaacacaaataatcttattttaaaatcagcaacatcaatggctgattagatgaaggaactgtggtacatatacaccatggaatactatgcagccattaaaaaacacaagatcatgtcttttgcaggaacatggatggaggtggagcccattattcttagcaaactaacacaagaacagaaaactaaatactggctgttgcatttacaggtgggagctaaatgatgagaacatatggacaggaggaggggaagaacagacactggggcctattggagggtggagagggaaggagagagaagatcagaaaaataactattgggtattaggcttaatatttgagtgacaaaataatctgtacaacaaatccccatgacacaagtttacctatagaatagacctgcacatatacccctgaacctaaaagtttttttaaaaaaaatgggcaaaagacctcaagctggaagccatcattctcagcaaactaacacagaaacagaaaaccaaataccccatgttctcactcataagtgggagttgaacagtgagaacacatgggcacagagaggggaacatcacatactggggcatgtcagtgggtgggggccaaggagagggagagcattaggacaaatatctaatgcatgcagggcttaaaacctaggttgataggtgcagcaaaccaccatggcacatgtatacctgtgtaacatttacatagacatttctcaagggaagacataaaggacacattttaaaagccctaataaaattattagttcagcttccagttattccttattattggtcttgctttaaccttgtacccaggtttctacaactaggccacctccttgctttctagtttcaacaaataagcccgtcttatcctgctctgttaacatgatagagtgggttttttaccacaaaaaaaaaaaaaaaaaaaggagtataccagtatcctatccttgtgtaatgaattactacagatttaggagcttaaaactacacatttattgtctcacatttttccatgtctcaggagtttgggtactggttagctgaaatctcttctcaatatctcatcaggtagaaatcaaagagatggctgaggctatgatttctttttttcttttttgaaacggagtcttgctctgtcacccaggctaaagtgcagtggcacgatcccggctcatggcaacctccacctctcaggttcaagcaattctcctgccttagcctcccaagtagctgggactacaggcatgcactaccatgcccggctttttttttttttttttttttgtacttttagtagagacagggtttcgccacattggccaggctggtctcgcattcctgacctcaggtgatccacctacctcggcctcccaagtggtgggattataggaatgagccaccatgccaggcctaggatttcatttgaagtttcaggtcctcttccaagagtactgttgttgaaaggagttatggtgtgtgtgtgagtgtgtgtgtgtgtgtgcgacagtatgactgtcttcttgctagctgttggttggcaaactctctaactcctagaggccacacacacttagggccttgccactcctctcacaatctgatcacttgcttcttcaaagccagcaagatactgtttgctgctgaatcttgtctcttttacgggtttgcctgattaggtcaggcccaccaagaattatcttcctttaatttgaaattttaacttgaagtcaactcattagaaccttaattacatctgtaaaatcttttgtaccatatgacataatctaatcacaggagtgatatttcatatttactaatcacatttacattcaaaaggagaagattatacagagcacataaaccagaaggcaggaatttgggtggctaccttggaattttgctgactgcagaagggaaatgaagccaatttcatttggctgtcatgagcatctaagatgttgaatatatggtgcctgaaatagtgtgggagcatagctgatacgccacggatgcagattattactcctacatcatctgagcctctgccatagttccttgtttggtaccctcgaagacttaaaaaaccagagtaaagtcttcttttttattttttcattttatttttatttatttattcatcctactgtaagttctgggatacatgtgcagaacgtgcaggtctgttacatagttatacatgtgccatggtggtttgctgcacctaccaacccatcatctaggttttaagccccgcatgcattaggtcctaatgctccccctccccttggcccccaccccctgacatgccccggtgtgtgatgttcccctctctgtgtccatgtgttctcactgttcaactcccacttatgagtaagaacacggggtatttggttttctgtttctgtgttagtttgctaagaatgatggcttccagcttcatccatgtcccttttaaaaaaaatttttttttttttagatggagtctagctctgccacccaggctggagtgcaatggcacgatcttggctcactgcaacctctgcctcccaggttcaagcaattctcctgcctcagcctcctgagtagctgggattacaggtccccaccaccacgcccagctaaattttttttgtatttttagtagagacgtggtttcaccatgttggccaggctggtcttgaactcctgacctcaggtgatccctccgcctcggcttccctaagtgctggaattatgggcgtgagccaccacacccatccgagaaccagagaaaagtcttctatatgactacatccatatcagagttcccttaccaagcaccagacttaccagctaggagacacttggaactcctcccttcccccagtcattaaaacacaccttgaagaatttctgctataggaatttatactgtcaaggctgtggttcgcatttctagtgggattctgtctcttagctattcttttttttcccaatatccttaaatgtaagaagggcttccatttaggagggtcttagccttctctatttctgtggttatccttgcatgaaaacttggcatatatttgagtgatgtcatgctcaaagttggaagctgcaggcatcagactttaccaaaatagctattcaattggtaaagaactatcagaatcaactattttgcaactctagagtctatttgaacccttgagtatccaagaaagcgtatgaagaagaaatatattggtaaatttcagtgaattttggcattttgaataaaagctactattccacaacctctagcccaatttcagggaactgtggggatggcagacaatattcctattgaagctggtaggtgccaggacaggaagtaagaacgttatcctctaaaaattggagttgcatgttttgatctgcctgttcagtggagaaccagcgtggaggctgactgtcattttaactgccttaggctgaatcagaatccctggcctctattgaaaaaatttaaagagacgagacatatttttaaaattttcttattggatcaagcacttaagaaatctctgtcaagtcatcggctggccttggagaagatgggacaaagactacagtaaccacacataagcatgaatataatcgttgtaaaaattgccttgcaagttattaaagatgacaggagctctcaatgagtaacaatgacaacttctggagaaaaaaaatatggcatccagaatttgaacattataaattacagtgtctagttttcaacaaataattctaaagtatacaaaggaaaaggaaatcatgacccattcacagagaaataaacagaagaaattgacacaaactattcctgaggatacccagacattgggctcattagacagactttaaattaaatgtcttaaatatgcttaaagaccttaaaaaaaaacacagaaaataactaaaagtggggggagtagaaccatgaattaacaactagggaatatcaacaaaggaatggacattagtttaaaaggaccaaatagaaatcctgaagcttttgcgatataatagctgaaattaaaaaatgcacaagtggagtttaatggtctatttcagcagatagaagaaagaatcagtgaactcaaagacagggcaactgaaatgattcagtctgtggaaaagaaagaacagagaataaagaaaaataatcagagtctaagaaacatatgagacaccatcaggcacaccagcttattatggattatggacattccagaaggagaagaaagacaaacattgagacaaatgtatgtaaaaaataatggctgaaaacttccaaaatttgaagaaagacatgaatctacacatacaggaagctaagtgaaatctaagcaggataaattcagatattcacaccaagacacagtataatcaaactgtcacaagccaaagccaaaaaaagaatcttgaaagcagaaggagagaattaacttgctatacaaaagagatttccaataagattaacagctgatttctcatcagaaaccacacaggcaagaaggtagtaggatgatgtgctcaaacaaacaaacaaaaaaacactgcctaacaagaattctatgcttggtaactttaaaaatgaaggagaaattaagacattctcagataaacaagagctaagggagtttgttgctagaagatacccttactctataagaaatgctgaagagagtttttcagaatgaaacaaaagatatcagatagtaactcaaagctatataaagaaataaagatcactggtaaaggtaactatataatacataggtaaatataaaagctaatatttttccgtttttgtttcttgtgtgattaaaacttgtagaaaacaattactatcccagctactcaagaggctgaggcagacaactgcttgaacccgggaggcagaggttgcagtgagccaagattattacaccactgcactccagcctggtgacgaagtgagactccatctcaaaaaaaaaatctcaaaccaaaaacctaactttacactttaaggaacttaaaaaaaagaaaagtaaattaggcccatagttagcataaggaaaaaataagaattatgtcagagataaacaaaatgaacaataagaaaattataagaagaaccaaaaagttggtgctttgaaatagaaacaaaactggcaaatctcaggctagactgacaaagaaaaaataaagaaaagtcacaagtaactaaaatcagaaatgacggtggggactagtttctgctgacattacataaatagaagagatttcaagagaatactacaaaaaattgtacactaacaaattatgtaacctagagaaatttctagatacacagaagtcaccaaaactgattcaagaaggaatagaaaatcttaaaaacctacaacaagtacagaaattagttagtaactgaaaatctcccaataaagaaaagtccaggaccaaatgatttcactggtgaattcaattaaacatttaaggaagatttaataccaattctgcttaagtcttccaaaaactagaaaaggaaaatcttcctaatacattctatgaagtcagcattactctgataccaaaaccaggcaaaaatgccaagagaacactaaactatagagaaatattcctgaagaatactaatacaaaactgcttaaaaaaagaaaaacttgaaaactcgattcaggagcatattaaaggattatacatcatgaccaagtgagatttatcccagtcatgcaagggtgattaaacaaaaagaaatcagttgatgtattatactaaattaataaaatgaaggaaaaatgatcttaattaatgcagaaaaagcatttaacaaaattcaacacctttatgtgataaaaacactcagcaaactagaaacagaaaaagaactttcataatatgataaaggatgtttatggaaaatgccctttatccacaactagccatttcactccttgaagaaagactgaaatctttccccctgatatcagaaacaagtgtgctcacttttcaccactgctatggaacattgtactggaagtcctatctatagtaattaggcaagaaaaataaaaatcatccaaattggaaataaaagcaaaatatctctatttgcaaatgacatgattctatctgtagagtaccacagagtatacaccacaaaactaatagatctaataaacacattcaacaaagttgcacggcacaagatcaacactcaacaatccactaatataccagcaatgaatcaatgtgaaaaggtaaataaaacaatattatttacagtagtacctaaaagaatacctatatacctagaaatacatttaaccaggaaagtaaaagaaatgaaaccaagaaagtgaaagtatatactgaaaactacaaaacattgctaaaagaaattcaagaagacctaaataatagaaagacatctcatgttcatcgattggaatacaatattgttaagatattaatattccctaagcaatctacaaattcaatgcaagtgttataaagatattaatggcccttttacataaatagaaaagcagcccttcacatttatatggagatgtgtagccaaaacaatattgaaaaacaaaacaatggtggaggactcacacttcccaatttcttagatgcaataatcaaaacaatgtcatactggcataaagacagacatacaaccaatgaaaataaaagtaaaaatctagaaataaacccaagtatctacaatgaccactttagttcaacaaacctgtcaaggtcattctttggaggaaaataatctcttcaagaaatggtgctggtgtggccgagcacggtggctcacacctgtaatcccagctctttgggaggctgaggcaggtggatcaggaggtcagaagatcaagaccatcctggctaacacagtgaaactgcgtctctactaaaaatacaaaaaattagctgggtgtggtggtgggaacctgtagccacagctactcgggagactgaggcaggagaatggtgtgaacccagcaggcggaggttgcaaattgagccgagatcgcaccactgcactccagcctgggcgacagagtgagactccgtttcaaaaaaaaaaagaaatggtgctggggcatttggatgtaaacatccaaaggaatgaagctgaacttgaactacctccatatacaaaagtctactcaggataggtcaatgtcataagtataagagctaaaactataacatcactaggacaaaacctaggggttaatattcaagaccttggacttatgggacacataaagattcttaggtttttacataaaagaacaagcagcaaaagaaagttgataaatcgcaccttatcaaaattaaaaacatttgtgcatcaaagaacattgatagtgaaaaagcaagagagaaaatatttgaaaatcatacatctgatagaggtttagcataatacagaatatataaagaatgcttacaattcaaacaccaaaagataactcaattaaagatgagcaaaggtctggtttgtttgtttgttttgttttattttgagacgtaatatcattcttgttgcccaggctggagtgcaatggtgcaatcccggctcactgcaacctccacctccccaggttccagtgattctcctacctcagcctcccaaatagttggggttacaggtgcccacaaccaagcccagataatttttgtgtatttttattagagatggggtttcaccattttggccaggctggtctcaaactcttgacctcaggtaatcctcccacctcagcctccccaagtgctgggattacagacatgagccatcatgcttggccaggcaaaagtctttaatggggatttctccaatgctatacaaatggccaagatacacatgaaaagatgtccatcgctggtcagtaaaaaatgcacatgcctgtaaccccagcactttgggaggccaaggcaggaggactgctggagtccaggagttcaagaccagcctgagaaacatagtgagacccacctctacaaaaaattttttaaaattagccaggcatggtggtgcatatttgtgggcccagctactcaggaagctgaggcaagaggattacttgagcccaggagtgaactatgactaagctgcataactaagctgcagtgaactatgaccacgccattatactccagtctgggtgacagagcatgacccatctctacacttcacaaccactaggatgtttataacgataatttttaaacatgaaaagtaactagtgctgcacaagaaatggagacatagaaatcctcaagcactgcctgtggaaatctaaaatgatgcagtatttatgacagtttggtggttcctcaaaagttaaacatagaattacattacaacccagcaattttacttctcaatgtatacctaaaagaattgaaaacgtacgcaaatagctgtacatgaatattcatagcatcacaatttacaatagccaaaggcggaaaaaactaagtgtctattaacagataaatggcgaaatgaactgcggaacatatattcagtaaaatattcagtcatgaggaatgaagtactgatacgtgctacaactttcattaacactgaaaacattacaataagtaaaagacgatagacataaaaggtcacatattgtgtaattccttttatatggcatatccagaataagcaaatactagagactgaaagcagatttgtggttgccagggatggggaaaggggaaaatgggtagtggttacttaatgggtgagggggtgttcttccgggatgataaaacagcttgtgactagagagatgtattggtatataacactgaattcatcaaataccactaaactgtatattctacaatgattaattgcttattatgtgaatttcacctcaatgaaagcaaattttgcaaatttggggtactatatgtttatactaagtgagtcaacataatacgatgtctgagagcttgggctctggaatccaccataccaatgctcaactcctgtgtgccttttgaaagattacctctcttatcctcgctttcttgatttattaaaataatatttctaccctcaagattgtcttaagagttagaagagataatacagataaagagatacacacacgtcctgatatgtagcaaggatttattaaatgtctgtttctctttttacctctctctagggagaccatgaagataagaggagtgtggacactgaccctggtctcctggtgaaagtcctgtggaggcaatccagctctgctctaagtattaggagtgcattagcttctttttgtttagtgttcttcttggaccaatcttgtctttatgtggaaatactaaacacaaagcagtaagattccatgttgtacctaaaggaaaatgcacaaatttgtccactgtacctactttggttctccagccttaggaaaaatgtactctccatgtagttagactagaacaccacactacgttcttttcagcctctctctctcgctctctctcctctctccataaggctgtgtgttgaagataaaagaatttagaaattaaggtccacactctctgcagacctccttatattatttgttcctctggtcctcagaaagacaacagtggttcctcaggtccccaggagagacctagtttagtttatccatcgccaactaaatcttctttatagaatatacagttgtctctcagcatccatggaggattggtctgaggacccctctagtataccaaaatccacagatgctcaaatctctgatataaaatagtatatttgcatataacctatgcacattctctcctcatactttaaatcatctctagattacttataacacttcatacagtaaagatgatatgtaaatagtctttatactatgttttcatagaatcatgacaagaaaaaacgttgtactgtacaggttcactacagacccaaccatccatttcttaaaaatattttcaattcttggttggttgaatccacagattcagaatccatgaatacagaaactcaactatacttggaacgaatgtggtgatattaaaagtctgttaagactttttttttttttttttaaatgcagtcttgctttctcacccagggtggagcgcaatggtgtgagctcagctcactgcaacctccacctcctaggttcaagcaattctcctacctcagcttctcaactagctaggattgcaggcctgcaccgtgtccagaatttgttccttctggtgggttcatggtctggctgacttcaagaatgaagccgcagaccttcaggtgagtgttacagctcttaaaggtggcgagggcccaaaaaatgagcagcagtaagattaattgtgaagagtaaaaaaaacaaagctccatgaaagagaaccggtaccggttgctgccgctggctggggcggtcaacttttattgccttatttgtccctgcccatgtcctgctgattggtccattttacagagtgctgattggtccattttacaaacgtccagctagccacagagcactgattggtgcattttacaaacctctagctagccacagagcaaccattggtgtgtttttacagagcactgattgattggtgcattttacaaaccacgtggaagaaaagttcttcaagtcctcacccgacacagaagtccagctggcttcacctctcaccaccatgcctagctaatttttgtatgtttagtagagacaggctttccccatgttggccaggctggtctcaaactcctgacctcaggtgatctgcctgcctcagcctcccacagtgctgggattacaggcatgagccaccgcactggccaacttttcttgaaaatctctcattttttgaaactccatctagttctcagagactcagatctctctgatcttattattccagcacttcaacatgtgtggtttcttttttatggtgggggagtggcgaagtctcgctcttatcccccaggctggagtgcaatggctcgatctccgctcacagcaacctccacctccagggttcaagcaattctcttgcctcaacctccagagtagctgggattacaggcacctgccaccacgcccggctaatttttgtatatttagtagagacggggtttcaccatgttggccaggctggtctccatctcctgacctcaggtgatccgcctgccttggcctcccaaagtgctgggattacaggcgtgagccaccgcgcccggccgtggtttctgaggtttccacgacagaggaagagttgccagagttgcaatattcttaactgcttcatgccagaagagacatatatccttctcttcagagtccattgacaataactaagcacaccgcctgtcctaaaagcaggggaatccagggagtgtagaggagaacatggagtatttggtagcccttgtctttgccaaactccttatcctcattcagcaaaattaggattaaagctgaatttgatggtgaggtcttcatggatgcaatagtccactaattttgtacctatttaattgtcctccatctgagtggactgaaggagactcacatactaggctactggcaatttggccagcacaacaggtgcaccaggttcctcctaaggtggaaaaatttgggtcaaaattaatgataaatgaaaaaaaaagagataatacctgaatgcaaagtgtggaatatatggacactgttgaagggaatatccagcactatatcagtgccttgagagttcctcagagcaagagaataatgttttctctcagcttaaattccagatgttcagagggggacgtaatacttttgctaacgttgcaccaattctgaaatcttactaagtagaaaggcaaccagcatccctaagtgccatctctccaggggacacatttctcccatgttgtgctaaagaaaaaggaacaattcctgatgagtaagcaggactctttttttttcttccaatgcaaaacattttaataggtagtcaaatatacagttattagaattatgtaaatatcacgtataaaaattggtataacacattagatgattctatgaaataaaaacacaaatcacacattgacaataacccctgcagtccaaatacacccccacaatacgacaaattacaaacacatttaaaaaaaaaaccctacagacatttatacatttaacaaagtaactgtgactagactaaatacattcattcatcaagtacaataaatttagcattgctgcttatagtcactaataacacaattttaggtgcaatttcacatgctttcataaatcttccagtacagttcccatagtaaagtgtctttgtgcacaccatttccatttatctgcaggtgcatcatacatcatacttaaaactatttcacttcaccaactgttaatatatattttaagtggagagcaggtaaaaaatttaaacctcaatgatgacaaaatttaaaattaaagaaaagtcttgaaagcctacagtgatttgtttacttgcataagtaatattttcacttagtacaggctattaaaataagtaatgagaatttaaatattaactcaaaaaaagatagaggctccaaacttttctaagaaattaatgcattttcaatataatcagtctgtaagtcaaaagtaattccatattcattgccaaatttaaaataccagtgatgtgaagactgaggcctaaaactgttgtgctaaattgtaaaatacagtaaagaagatgcagctcatttgcttgggaatatgtaatggaatgttttccacagtaatgtttatgttaaacattactttaaatgggcagtctaaataaacatacctttgccagcaaggaaagtgaaaaattaaggcttttctatgctatctgtaactactacccaaacttaaatagaggttacaatactgcaaaatattacttctaacttcaactattgttggctgcttcatttcaaccttattatcttatttacatgcctatttttctatatctctatttcaattaagtccccaatcccaccctatccaaagagaatgctgaaaatggttaggcccttacctgtttggttcacagttgtaatactgggggctaaaaatgcttaacacatggcataaatccaagaaatacctttgaatgaactagaagcctggcctccaaaggcaaccccacttgtttttccaaagcattaacagataattgttacctctttagataaccagattgacaattattaaaaaggaatcggtgtttcctaggctatgaaaacatcaaaaacatgtaatagaaagggtaacttagggtacaaacgtatcaaatcaaagctaaaggcactggagaaagaaggtaagcattgtaaacaatttttaaagcaaatcaagttttaaagtataaaacgccaagctactaagagaaaatgtattaaaatgatgacaatgttttactatagtggacacaattcctgtaatttcgcaaacagaattctttcgttgttctatcgttttctttcatcctacatcttctataatattccaacccctaaaaacaaatgcattttcagctgtgtgaaacaaaaaaatgcaactgaagtatctatggaaattcctttctcttaaatgatgttataaatttgatacataaacttgatagacataagaacatcatcttggaaatcataaaatactaaattatgctcaatcgaaatacaaaggttcttattcagttgaacagtttagagccccataagaacaaattgtagtgtaaagaggaaaagtaagtacaatctttccagacacacaaaacaaagaataatgaatactgagttgaaataccacaagctccacattagagccatttaatatacacattttcataactgtttcttgaaaaactatttaggtaaaatatttagaatttatcatttattttaatttatttgaatctatgcaatgtccatccatattaaaatatcaattaaatactttattataaaactattatacaatttaaatttttattagaaaaaggtattattcacatccacaatttcttaaagtcctttttaaatacgtgtattccataagaaacacactaaaatcattacttatgtttcataggggaaaaaactgtaaggatcctattaacccaaactatatccgtattatgcttatttcttaagcatttacatgttcaaatatgtttggtgagtagtgatcattcatccccacagtggtaaatttcagcacaatattaagtgactgagagagactaaaatagtcacatgtagattacataaacagatacttattctgttatacctaagcttacttataaagcaacataaaatgagcattggataacaatgataacaaatgtaaacaaacagaattaaatattaatcccttccctgaaaaacaacagataaaagggcttcttgctttattaaaaataaaacatgatctattgtatcaaaaaggtaagacactgattttacaaaattatatttccaaatacagataaaaaaaagttgaacagttaattcagattttattgagctaaaatgtgcaaaaaatctgataatacttaagtttatttaattcattgtgcataggttgataatatcccatccaaaaaaagcctcagtatcttgttaagactcaaaatagtatttaattatctgagcttaagatttattgaaccactatccaaataacaacaaaagtccatattgtaaaagaaagaagtgaaactaaaaattttctgattgttaattatgacttgaaattcattcattcataaaactatagccaatattcatttgaaaagtgaagaaaaattggaagtccctatgataaatacatcaattctaaataaaaaattaaaatcaaatttttctattacaaaatgcacatgatcggtttttttttttggatggagtctcgctctgtcgcccaggctggagtgcagtggcgcgatttcagctcactacaagctccgcctcccgggtccacgtgattctcctgcctcagcctcctgagtagctgggactacaggcacctgccaccgcgcccggcctatttttcgtatttttagtagagatgggctttcactgtgttagccaggatggtctcgatctcctgacctcgtgatctgcctgcctcggcctcccaaagtgctgggattacaggcgtgagccaccacacccggccaaaatgcacatgatcttttaaattattcaagtttaatagatttactaaggatagagttcatagagcatttatttggttcttctgtttggactcaggtatttgcaaaacacccccagagaaggttgagaaggtaaaataaagataaaattgtgataattttctccacaccacaacaaaggtactcagatttaaaaattcaatttgtaactctagaagaaaaataggagaaacaatttacatccccaaaataattttccagaaatatgacaaaacgtataactccctagaaatgttattagtgaatcaaagtgcaagtaatgacaacattcacgtcatatgtatttgaagactcaaatgttttaaatgttttcaatgacaaataactggttgatttttttttaaggtggtgggtgggaaacaaagataatacaaatctaatttttccaggaactgtagtactgtccctgtccccatgaaattaagttataatttcactgttcaaaataatataaaactattttgaacaagagtgaaatagaagcatgaatttagatacgcaccaaaccctatatgacggactaatttacacatagtatttttgataacaacctaattagatattatctttcattgtttactataattccgagaaactgcttttaacaacatacatttacactaccacttaactaaatggggacatataaatacataaatttttaaagaaaacaattcaagttatttagaggagaaataaaacttcaattatttactttttaaagctgcatttagataaaaagttatatggtttatgatacttttcacaatgttataaatttatattccaattttctcataaatgaaagattgtaaagaaaaatattttgttccttgaaaataacctctctcttcccctaaccccagtaaggacaattagtgtgcccttaatttcgagactttgttgttgtcatccacatcaactgtctttttcatgaagtataatattttgagagagagatgtaaaaattaaagagaaaacctgcttttggaatgcagcaattctaaatcatttcactaagaagcaccctttgatatgctggtccgaacttttaatataaaacctaaacaccacttatttctgaagtagaattttcaccagttttagtaacttcatacatagcaatactaagaacaacaacctgtgctttcgagatcttggtaggtgttctaataatggaatattttagatatggctcattgtcaaggctgggtggacagagttggacatgaattggctacagaaagctaactaaacacttagtgactgaataatgatttgcattttgcttgagccaaaaaagatgtttaagccatgtaccaccacattccctgcttaacattcctaagtttctttattcttcatagctttctaatgaacaaataattagttttcctgagaaagagtataaaaaagttaacctttcttccaaaagtataaagacaaataaaatgttgactcacaatacaaattttttacatagcattaaaggtgcagagatattgactgctcctcttcattatgattggcccaccccttaaaaagactgcaacagaggattcaattgtctaaaatacttcgaagtacagaaattaaatgctttagcccataaatatatccctcatctattgtgctgctagggaacacatgagcaaaatctatcattcgcactcctacttcagcaatctcttggcaaccagtgggaagatggtagaaaactttttccagttgggaaagtacatttccatttaaatgttctgtgacatgcttttccactcattgtcttgctccagattttcaactttcattgaagtctgactgtgatggtttttgtatacattttcctgtgacgagcatacatcttggacaagtttttgcccacttaagcctctatttttccattcactgtggaacttaatacatgaaagttattattgtactctagtacctctgtgtctgacagttgtcctttggacaaaaacttttctgccaaagttctgtcattcaattttgtagtggttggctgagatgaactttcataaaccaatagtaatgaacttgcataaaagttaagctgcttctggttttcaaaccactgcagaattttctcaatcttctgaatactggcagcaacagcatcttttcttaagcagtacccattatgaaaaaatccggagactccatcctttgtagttccttttgttaagcttcttccataatgctggttttgtatatcatagctatcggaatgaacatggtaaaccctcatgccaagcaccaagaaacccaatctcttccattaatgggtacttgctgaatcttctcagatgaggcaaaaggatcatagcttttttgccctatctttatattcattatacagggcttattaaatttatgtgtcacatcttccagttttaggtataaatcgtttggtgcagtgggaggtgaccagatgccatattttggcaaatattttcgtagctctagaagaacaccatcagaacagtcagcagcataaaccgtatgctctcttgggccccttggaggtggttgtaactgtttcaaagctgtgccatctgagtgttgcagtatacccactttgtccttcccgttcatgtgtccggccacctgatacgagaggggcacttagccgttgaggaggcggagtctgccgcccgccggctgcccggtgccctcagggatggcctcgatcgccggtggggcccgcatttccggggggctggcgcctcgacccggaggggtgatggtggctcttttgccataaccgagagcagaagcggtagcggtagcgagagcaggaaaaaaatagggcgagggagggggcgccggagaacccgagggtcgctcaggctcgggcgcgaggaggcccgggggttcccgcggctggtgcccgctgaggccccgagagggggcccatgacaaccaggggagggggggcgtctgcccaactcttggcggagcgcggctcccggctccggctcctgtgcagccgcaggccccggcgctgcccagtagacagactaagcaggactctcttaatgtcccttaagtcttttggttcttgttttacaggacatatcaattagattgcaattaaggagggatctcggagagtttctcccttctggcagctatgatgtacagtcatatcaggcaggcagactaatcattgtgtcattaatctgatggccaaatgcttaggttcctgagtataatggaaaacaaatagtggcagctatctcctagtgtaatgtataaaagaacttaaacctttgtctttatggatggacagatgtcacacaagattaaaacaaaaaattacttcagatgctgataaagcattgggctcacatcccaactgaagttaactctgcagcgagacaatggggggttatgggaagctttgtggcacactaaaatgtgtatgaatgaccactacacatttgaccttagtatagaggacccgacaatttggggtacaaagtatgtatttttattgttcccaggcaattagcactcaacaacaacagcatgtgtagtggattaaaagacactgggcaacaagatgaaagagagctctttgtgaaataggtatgggtataggcatggtaagacaagcaaagttttccttcagtataaaggacattcaaaagaaaaagatcaatagcaaaaatagacaagttggaagaaattatgttcaaacagtaaagaacagaatctattgatgctgctatgatgtgaatgcttgtcccctcagaaactcctattgaaacttgatccccaatgtggcaatattgagagaaggggcctttaggagatgattgagtcatgaaggctctaccttcatgagtgaattcattcattcatagattaataggttaggccaggtgtgatgacacatggtggatggcttccagcactctgggaggcaaggcaggaggatcacttgaagctaggagttcgagaccagcctgggcaacaaagctagaccccacctctacaaaaacatacaaaaataagccaggtctggtggtatgtacctgtagtcccagctactggtgtggctgaaacaggaatattgcttgagcccaggagttcaagactgcagtaagctatgattgcaccactgcactccaagctgggtgacagagtaagaccccatctctaaacaaacaagcacaggttaataggctactggattaatggactgtcatgggagagggactggtggctttataagaagaggaagagaaacttgagctagcagattagcacactcagccacttcactatgtgatgcctgccttgggactctgcagagagttcccagcagcaggaaagctctcaccacatgcagccactcaaccttgaacttctggggactccagaactgtaagaaataaattcgttcgctttataaattacccagcctcagatttcagttatagcaacataaaacagactaagacagatgccctagtaaatcaggtcatagaaacccaatctaccatattagaaaatgacaaaacacaaaaaactcattatcggaaaagagcacacaagctagtccaacagagccttcaaatcatgtttcttgaaatggaggtcaaatgagtcataggcggtgacctaccgttttagttgcagcagaagctctagaagtacacttctgaaaaatacgtgatctcctgaacttatgaaaattttcttgaggcaaaggcaatttatatcaatgttccctaaatgctcttattccaagaataaaccaagacgtgacatattgtgtaaagaatataataaacaacacatgtatactccttgtggaatcaaggagagcttttttacatatgtaacaccagatgggaaccttgtatctgtgcaaacatactgacagaggctaagagattagctttgtaccagttagcctgaaatccagaagtaacagaatcataagacactggtaacaatcccagctcataataatatctagtatatgggtaaagtccaaatctactaacatgattttaataatgctataatgctcacccaattattttctaacaatacgaaagtatagcatagggctgggcgcggtggctcacgcctgtaatcccagcactttgggaggccgaggcaggctgatcacgaggtcaggagttcgagactatcctggctaacacggtgaaaccacgtctctactaaaaaaatacaaaaaattagccgcgcgtggtggcacgcgcctgtagtcccagctactcgggaggctgaggcaggagaatggcataaacccaggaggtggagcttgcagtgagccgagatcacgccactgcactccagcctgggcgacagagcaagactccatctcagataaataaataaatatataatagcactgtggctcatacctgtaatctcagcactttgggaggctgaggctggtggatcacaacgtcaggagttcgaaaccagcctggccaacaaggtgaaacccatctctactaaaaatataaaaattagctgggcgtggtggcactcacctgtagtcccagctactcgggaggctgaggcagaagaattgcttgaacccaggaggcggaggtagcagtgagctgagatcatgccgctgcactccagccagggcgacacagcaagactctgtctcaaaaaaaaaataataataacataataatactccaatatggtgtaaaattgggattattggtaaaatttggctatcttatataaatgcatcaaatgatagtactaatgttgagtgaatatactgagaaattgagttaaaacttccttgggttgtaatatcaatagagacactaattggcctgaggaagaatgagatttaattaatcaattaatcactataataggtgtttctgcagagttttctcataaagtaagatagccatagataagtaaaaatcaataattaagtttatataacagtaaaaagaaatatgttgtggaacattgaatttaacagattatttctttaagtctgccccccttcctcactaacttctgcaaatgatgcatgtatttgcattaccattcctgttttaccctataaataaatggtacactacatgtagatttaatagtgttataaataatttctttgtaaggtgaaactgactaagggtcagaggtaaactgcaaggaataaaataactcagcaggtctgttttatcatttttgcttctttctgtagccattgtaatgcctcctggctaagtgctgagaaccaagtcccggcatgtgcacatggtaactggttaatgatattattctgcatgcccaaggcagtggtcaggatgcatcagactgtcagcattatgtaaggtaaacctgaaggttcatgatgtgatcctgatgcctggtttgggacactattgctggtcatgtaaccatgtgaccagtatggatcacaaggatcaagtgagcttcccaaagttgagacatcttggacatgacttttctgtttgcagctggaaccctcatatgctggtccatgcaagcctcatatgttgagtcgcgtaatttctccagtgaatcaccaaatttgtgagtagttatatgacttccctaaacaatcaaaggatctgcattaaacctataaagtctttcactaaattccctcaacatttctgacccagcaccatagctgtggatgtttcagtggtatttacatataacccaaagtacattcctaaagaaagtagccatttttatctttttcagcaagatatagttgaatccatctaatatcaccattgccactacaagtaagctatcattaaaaatctttgctattttagccaaaaataaaataaaataaaataggcgagatgaaatattttttcaaatagttatttgccatttttattcacattttggttaaattgtataatttttgttctttatcttagcagtacttttttatatatttaaacaaattcaatattttgcctgtcatcttagttgcaaataatttcctagcttcctagatcagaaattttgctacaacaaatacaatcctttactccaataatatattttacttggttattactaacatataaaaagtattgtctttatgtacttatttagaaattatattaaagttttcgatggattcaagtggattctcactagattctaacagttgtttcccaggcagtactcagtaaagtttaaaatgatcatttctcccttattcatgtccaggttaaataataattattcctaactttaaaagtgtctgctagtatttcttatttaagaatgttatcaggtttaaaattgagatgttataaagaatatttaggtcaggcacggtggctcatgcctgtaatcccagcactttgggatgtcgaggcgggcagatcacgaggtcagaagttcaagaccagcctggccaacatggtgaaccccgtctctactaaaaatacaaaaattagccaggcatggtgacgggagcctgtaatcccaaaaaaagaatatatgataagtttgatttaatgacttcagaagatatttacatagtgatgcactatttctcatttgacagttggtgtgaaatcccgaaagtctgttctcactctgcacagtaagtagtgcaggactgtaagaataatccatgctgaaatcatgcaaaccaatcttttttttttttttttttttttttgagagggagtcttgctctgtcgcccaggccggagtgcagtgaggcaatctcggctcactgcaagctccgcctgccgggttcatgccattctcttgcctcaacctcccgagtatctgggactactggcgcacaccaccaggcccggctaatttttttgtatttttagtagagactgggtttcatcgtgttagccaggatggtcttgatctcctgacctcgtgatccaccagcctccgcctcccaaagtgctgggattacaggcgtgagccaccacgcccggccgcaaaccaatcttattaactaatgggaagattatgattattctagggccttaaaacttttgtgaatatattgaaaagaatctgttgctgtcagctactaacacacattactaaagctaagtttatttagtacactataatttaagaattggaaatgttgatgattgaagtgtttcattgctttatttaaaacttccaaagaaaagtttgaatggtgtttgccttcctctcctcctcatataacttttgctatggagtgctcatcttttctatgcctgggtttattgtcacgctccacgctcctttctaagtctggatcagatgctcacatttaatcctttgcatctttggtcatgcagtatttctgaaagccctgtaatgtgaagcgatgtttcgccaatgtcacttactctgggacatctttgtcctttatatcataacctctctcctcctttgtactgataagctcaccttcactaagttcctctggctgcgtatctagtgtcagtagtgtcagccccatggtcagttgtttcttctgtaactccatttacttttgtttcaacttttacttccagcattacctcttttcatttcattttacttttatcttcactgttcaactctcttttcccattgtccacttacttttacattcagagagcagattcttttgactcgacagagtctcactctgctgcccagactggagtgcaatggcgcgatctcggctcactgcaacctccgtctcccgagttcaagtgattctcctgcctcagcctccagagtagctgggaatacaggcgcacgccgccacgcccagctaattttttacattttagtagagacgtggtttcaccatgttagccaggctggtctcgaactcctgagatcaggcgatccaccctcggcctcccaaagtactaggattactacagccgtgagccatcgcgcccagcctttttcattgtttattcagcaatttttcatatttataagtaacatcaggcactacttttttcagtagcttgttttttctactttcatgtgccattgacgttagaaaacttgatgaaatggaacagaggagcttcatgctttctacgtttctgaacaacaagtcgtacatctgggaaataacttttttttttttttttttttggcggggcgggtggggacagggaacggagtttcactcttgtcgcccaggctggagtgaaatggctcaatctcagctcactgcaacctccacctgccgggctcaagcaagtatcctgcctcagcctcccaaggagctgggattataggcgcccgccaccacgcccagctaatttttgtattttatatttatatttataaatatatatatatttttatttatatttatatttataaattttgtattttagtagagacagggttttaccatgctgctcaggctggtctccaactcctgacccgcccacctcggcctctcaaagtgctgggattacaggcgtgagccaccatgcccggcttggaaataactttttttctttaagtgttttaaaatgaactcacatgaccctttttactagtaggtgctggattgcccagcttcctttagctgttgttaatattatcaccctcgatttctttcagttaacatttgcttggtcattgctattgattatattcttattattatgcttcatgtttgttgtaaagagcatatacttgaattctgtgtgcatacgggtgtttgcgttttaattctatctgagtcgtttcaggatgactctttcaatttgatcttgcttatgtcattttctcttatgatttctaaatttacgtttcctttctagtctattttattttcttcctgaatgatgttgtttgctattttttttcaatcatgtggatgatatataacctgctataaacccaataatggttctcctgccatttaaaaagacatttgtaaactgctttcctgtgtgttagtttaattttttcatcattcattttggtattaaaagttgacaaagcattaaataaaatgtgaacaaatatgtaagggcaaataatctcaaaatataggagctatagtttggtagtcacataaaaaaggctgccagatttagataagatcatgtaattattttctacttgaatggtttctgtagttaggtgtcccattttcctgtcttacttaaaataaggggaaagaaaggcaacagcagtagttgatcatgaagattcatgatcttttcaaagacatcgactccctacaaaacagaaaaaggagtctacagagactgtctttgcaaataattatctttgcgcagatgtttctgtacttagacgtactccttttcatcattagtttccaatttactatagggaagttgtctttccagaatattttacatttctttatttcttcatttccttttttcctttcttctcttctttttttttttttttctttttggtatagggtattaaatctagaaggtatctcagagaatatctagtttaaccccttagaaagtcgatgtgacttgtcaaagtcactgacattcagtaacagaagtagcatttgagcactggtgtccaggtttcccgcacatcagtcctgtgctcttcccatcacagttccttgtcttccctgtctttcatgttttgtttctttcatactcagaataaataacacagtattttcccatttaattgtctggatcgcctcaacacaattctaggggctcctaatctgaatggcttcattccatagattgtgaaactaaaccaaacgcacacagacacacagtgaggtgcttagagtcagaggttgcatgggcacttactacactggagtgacaccgcaggcatttcctttctgatcactcagtccatagggtgataaccaataaatacgagcaaaaccagtataactgagattggcaagaagcctcctggactccaaaagtgtgactttaaagacagaaaatacattattttccctatggctagtaagattcagatatttttatgagccatcagaggtacctttgtaggagtcctttagaaaatctttcaggctaacattattttgtataaaccaacactgataggtaatcaaagtgaaaaagggaggaacacacgttcctatctatggtttcattgatctcatcttacctctggccttcaccagtctaagtgatcatttcctcagactgacatgtccatcaccaaggcagtttctgtagtttgacatatgacctactgaagcaaaaatgccccagggtatactccaagtgaaaacagatagtgaataaataacgtggattccaaagcaagtagcatgaagtgttgaaaagttctctgtgccaattctttgacttttctctaaattctgaagaagttctaagttaacaattcatgattatccatgaaatgaattaatctgaaccctgttgacttttgtctgatgcaactgtgctttaattcttattttaattaacctgtagatgaagaacacataccagctcaaagctcatttcccaaatgaaacattgtttgagctggtgtgtgttaatttcccaaataaaacattgttgtttcactctttgagatgtcaaattaaattggttacaagaaaaaattctgactttgatcagtcctctatgccagccaggaacatttttattatagaaaatctgtatatgcagtgaagatgttgctttctcactgatacaagggcggagtagtcatcatcctttctgatgaaacacagatggtctctgcagagcccccattcatctttctgcaacagtgttgcaattattcagctaccttctcctgtcaccttctttgagaaagatcatccactccaaatactcttgctcccttttattggcacatattcagagccacatatgtgacatcttggacaaatacacccatcttaggaaaaaattttaacaggagtatgcagtagttagatctcctagaaaaactttttttgagttccatttatttctatcttgaaaataaaaacgatgtacttccaaaacagttgagaatatagaaaagcatagtggcagatagtaagtcacgtacaatcccatcagaaggggtaaatattattaatatttttacatattttatttcagtcttcattcatacatataatatgtctatttattaaacttcagcattcttttttgaacaatttatggataatttgccatatccttgtgtatatttctgaaacatgatgtttaattgctaataatactctactatacacttagccaatccttactggtttgtttttcatttttaacttttaaaagtaatattctgattaacaatgttgtgtataagtatttctctatgtttatgattaagttcttgaaataaattcctggaattacaattaagtcaagtaattaaatgttctcaagacagcataatataagaacctgtattttccaaatactcaccagtaaaagctattttaataagttaaatttgtttgacattccattcaatattaaaggattgaccttcaaatatttattgtccacttatattcttcctgtggacatctttttgttttgttttgtttttgagacggagtctcccactgtcacccaggctggagtgcagtggcgggatctcggctcactgcaagctctgcctcccgggttcacgccattctcctgcctcagcctcccgagtagctggaactgctggcgcccgccactatgactggctaattttttgtatttttagtagagacggggtttcaccgtgttagccaagatggtctcgagatcctgaccttgtgatccgcctgcctcggcctcccaaagtgcagcgtgagccaccgcgcccgtccgttttttccctttttttaaaaacacactttacttttacttccaggtgagtatttttaatactgttatatttttgtaaaatattataaaaatactgtaatagttttgtaaaatattttgtaaaaatttttaaatgaagctatttaacacatatgacatgctaatgttacttaatggattcctatgtatttcataggaatctcggcccagtccaggcgccgcgcgtggctggagctctggctggctgccttagtgtcatgcggaggcgtagcgaggattcagggacagtaagctctgttctcgccgagcagggggcgggctcgcgagatcagctgcttctggccgggcgggggcgtggactcagcgttctgggtggccaggccgtcgacctgcggcctttgttccgggccgctgccaggcctgaggccctcctgggtttcggttcagcgttagttaacagttaacccgccagggcaggcttctgcccaggcacaggagagccagtgagcttgttcaccttgaaacttgggccacacctgagacctgccacctcagggtggtaagcaggccgtttctaacaagctttcatggcatttgtgcgctttaaagtatagaagctgctccagggcttccgcagccccggccgtcctggagatactcgttccctggagtccgtagttgagaatttacagctcctggacagccacgtgcagtctcagaactgcaggcgtctttaccgaaatgttaaacacagcttgaagttaggcaggataactgccagagctggatggaccttagaggtgccagctaatgcgctgtgagcgttttctgaggttaggcctgctctaaacatttgatatgtgttaaggcatttatgtgctttgcccacacccctatgtggcgggcccttcttacagtaaaagaaactgcagcacagcgaaattaagcaacttgccccaaatcacgcagaactgggatgcaaacccaggtctagctcactcgtgatcacagttcaacatcagacgatgatgccaatttccagaacagctacgtgactttatataaaattattgggcaagcgttcaattgtaaacattcgtgaacatagctgttgcacattagctttcctatttttttttaaattcaggaccatgtttggtgacatatagatatcaatattatatatatcaccaatatacatctttgctttgctaaaaggtttttgtgtcttcaggatagtttacttgtaagccacatgtttttataaatccgtgggtgcaacctgaataaaactaatgcctaccccgtggcggttttgtgaagagtaatgaactattatattcaaagggtccaagcagtaggcacttactgaaggacagctagttttatctattattattctgccattcagagagatatcaaaactactctaaggcatttctcttccctgcacctaaaagcaagggtgtcatacttgagataagcattctgataatgtgtaggcaaagtttccagacttagtaaaagcagcttaatcatggctcaagaggagtgacaagttaccacctatctgcaattcaaggagaatataagatagagaagaaagcagtgaatgaatttcatttgattagcagtagattggacactctactggtcttgcctctctacaacctctcttccacctgacctctaaatgttgaagtgcttcaggaaatgtcttagaccttcttccttatctacacttcctctccaacatgaatcttgatggctctgcacaagatactgaaaagagggaatattcttctgtctgggtgggcagagaagatgacattaaaaaatctgaaagaataatagctgttgtccatgatagagaagtggtcattttctatcacaagggagaatatcatgctatggatattcgctgttaccactcaggaggacctttacatttgggagatatagaggattttgatggatgaccgtgtatagtttgccgctggcataaatacaaaattactttggcaacaggagaaggtctgtaccagactataaactctaaagatccatcagcaaaacccaagtagtgctccaaaggaataaagcaaaggattcacacagtgacagtagacaatgggaatatttatgtgactctttctaatgaactaatgactctgatttttatgccactggatacttcaaagtaattaagagttcttcctgataaaaaatacatagcaatgaaaaatattgtgtatgcttgaaaacatttttagaataactctgcttcagttttaaaagggatgaaatttttcaacataggcacaactatttaaaaatcatataaatttgagaggtttaagagcacacatacttagtatgatataaggattatcatcaggatcaatagaatacattttatcaaatcctctggattaattagaacctgaaggttataggtttggtatgttctgtttaagaaggatgaaaataaatttggagtaaacaaaataaataataggtaaaaattaaggtttagtaagaatttttttaattttaaaaatttaatttttaaaataggaaaaaatccctgtttgatgtagcagacttaattctggaaaagttttaatatatacaaagtaaatagactatataatgaacttccatcactcagctttaacagttatcagcattcttccattcttgttttatttatacctctatggattccctacctctcctatttgattgttatttttacatttttaggtaaagcttaaatacattgaaatgttcacatctgaactgtacaactttcccaaataacatagcagattttgtatacttaaaaaatgcctccaaaaatgagataattttacctgctgaacttgaaaataagaaacttaaccactgtgctagacatcaaaaccaaataagccttggcttagtttctctatgatcaaggcagatcgagcagtaaggaagccacacacacctgctgcccagccatgagagatgtaaagtctcctgttcaatgagtcaatgtactttgaatgcctatatgaaattttcaaataaaggttttttaaattttttttaaataaaaaaataggccaggcgcggtggcttacgcctgtaatcccagcactttgcaagcccgagacgggcagatcacgaggacagcagatggagaccatcctggctaacatgatgagaccccttctctactaaaaatacaaaaaaattagccgggcgtggtggcgggcacctgtagccccagctactcgggaggctgaggcaggagaatggcgtgaacccgggaggcggagcttgcagtgagccgagatcgcgccactgcactccagcctgggttaccgagcgagactccgtcgcaaaagaaataaataaataaaaataaaaataaataaatctcccacctgtgttaagacagttaaatatttcttgatgttagcttgaggaccaagtgagccatcttgccagttaagcaagtcttatttcagaggaccaaatggttaaaagaggagaatttgtacatttgttgagcttccccatctgaagcttgggttccgtactatcctattactatccatcttcatactgaatgaaacaaactgaaagggaattcataatcttttttcttaactgaacaggaaaacttatgaaaatcaacaataaatctgaattttaattttcattcaacagctgaaaaaccatgtctgttgaccacattggactattgcctagttaaaatccataaaattctctataaaccaatgaaaagaaagtagtctggcaataatttccaactttttaaatcctaatttttaggtcaggtgcaatgcctcacgcctgtaatcccagcactttgggaggcccaggcaggtggatcacgaggtcagaagatagagaccatcctggctaacatggtgaaaacccgtctctactaaaaatacaaaaaaaaaaaaaaaattacccgggtgtggtggcgggcacctgtagtctcagcaactctggaggctgaggcaggagaatggcgtgaacctgggagggggagcttgcagtgagccgagatcgtgccactgcagtccagtctgggcgacagagccagactccgtctcaaaaaaaaaaaaaaaaaaaaattctaatttttagttacaaagaaaaaggatagaacgaggcttttcaaggaattcttgctcatcccttcaataatttggtaggcaacacagtcctagaattcagcttcctttttggttttattactattaaatagatactttcatataaatggaaacatttttcctcaaaacatcaattcaaaacatactccttatattaatggctatggcaccacatttttggtaaattccctatgtgtaactttttcctgttggtatgtgatttttttcatttaatatgactatctgctggtgttgggggcaataggtttgtgaatattctgtggatatgtccatgcataggtgtatatatatacctatatttttccagctaatacctcaaatgtgtgattgtttaatatataccacactatgtttgcacagagcagggcttctattagcagtggatatttttatttcttttttttttttttttttttttgttttgagacggagtctctctctgttgcccaggctggagtgcagtggcgcgatctccgctcactgcaagctctgcctcccgggttcacgccattctcctacctcagcctcccgagtagctgggactacaggcgcccgccactacgcctggctaattttttgtattttttgtagagacagggtttcaccgtgttagccaggatggtctcgatctcctgacctcgtgatccacccgcctcggcctcccaaagtgctggaattacaggcatgagccaccacgcccagtggatatttttatttctaactttgaaaatcagtccacacaatttcattggtgtgaattctttctgttgctctttttcatattttaatgcagagattcctcttacaaggcccatgcttcaaacacaattatatctttctatatccagccagctggaaatatataggggtaagaagtatttcttgaaaagtccttgtttagtaagttagtaacaactgggatgactagttgccaagatgtcttgtaactgcctagcagatgacacctgccgtggcaagtctcattcacttcagtacaagactctgtacatttcaatctgatattctattttgccatttaagtacgccattaaaatcatagagattttcagtgacattggagtactgtaaatattagtttcaaaaagaattattttgaataggatgattaaaccaataagaagaaagaaacacacagaaatgatattttgcagtttatctgtattaagaaatgcttcttgccaatttctggttttggtttttggattgctacataagactttctttccatttactttatgtgtttttaaaagctgcaggtgatttttaaggtttgatggaattataatgggagccttgtataagttaaatgaaactggtaaaggagagcttactttgtctataatgctttcaggattataacttagatttaaaaatgaaatgtctgacttgtaaaatatttaatgttatatcagacttcaataaaattttctgcgagaactcaaagtaaatgcattagatttttaatgaatgttctgaatgaaatatgaatttttgtctttcagtctctgtagtttatctcaatatattaataaaaaggtctgttctcactgtaaaaaaaaattcatattataatgacatgaatatacagacttccaaattagttctttttatatctgtattttttaaacctcttgagttgggttatttttatttccatttcctggctcttctgccgcatgaaaatcatgcttccacttttcttgcaccctttgataagcctcaaagttactatatggggtacccgaaagacaagatattgtcactagcctcaaaaattttactattatggacacacagacaccaatggtttccctgtttctgaaagctcccagtttacacagatagaacttcatgctttatattctttatcagacttcacatagttgaaaattatttccttccaatctggaaaagatgatttttgagttgtaactgatcacaaattgctagtcagtctgtgtgttcatcctacggtttcaacatcttctaaactgtgtttatggtactagtcttaattcatttttatattaaaaacagtcattttcatcacacatacctgcatttcaaaattttttattagaagatgacacagtacaaggcagttgaacactaacttttgatattttgataaaaacaaaaatgggaatctttccaagtgacttttgagcaaggatctggtcatctatgtatttgataccagtcgctcaatattttaaggtaaatttaattgaagtatattacacatacataaatgtgcataaatcataagtgtaaatctcaatgaattttaaaaagaaaacacaacagaaaaacaccttagcattctctctaatgcctgcccctagtcataatccacaatccccctcctaaacagtaacaattattccttaattaccataaattatttttgtctgttttgaaatatttaggtaaatgcagttagataaatgtactctctttgtttaaggcctctttttataaacattgtatttgtggcatttattcatattttgtatgtggaaacagttcatttatttttactggtgaatagtatttttctcctgtgaaaacaccatagttgtattcctctgttctacttttggtgagcattttgtttgtttccaattttgatattttgattaagtctgtgatgaacattttcttttcttttttttttttttttttgagacggagtctcactctgtcgcccagactgaagcgcagtggcgggatctcagctcactgcaagctccgccttctgggttcatgccattctcctgcctcagcctcccaagtagctgggactacaggcgcccgccaccacactcggctaattttttttgtatttttagtagagacggggtttcaccatgttagccaggatggtctccatctcctgacctcatgatccgcccgcctcggcctcccaaagtgccgagattacaggtgtgagccaccgcgcccagccgaacatttccatacatctattttggtgcacagatgtgtggggttttgttgcagggtcataggatatgcattcatttacctttactagatactgtaaaatggttattcacagtgattgtacagcaaaaatttcccctccttacaatgtaaatgagaattccagagttctatatccttgctcagatctggtaatttctcctatttttgattagctctaatagtgagtgcatgaagttgtattaacttgctatactattgatccttaatgaagcatgcctcctggtattttgccatgtgtatccctacccacattgactctggtcttggccatgtgattagatttggccagtgggtgcttagcaagtatgatgcaagagaaggatttacaaccacttatgaacactgggaactcctaatctttgaatgctccttgttggaaatcagcttccacactgagaggagcccagtaatccacgtggagaggtctttgggggagaaccaaaacttctggtcatagtccaagctaagcttccagccaaccatgagcactacttgctagacacatgagtgaggtcattttggaaattccagctgtcttagcaatagtcaatgtcaccggaagcagaagaaccatggcccagtcaagtcacagagtcatgaataataaataattgttgttatattaatatgttaactttgggatgacttgctaccaagtaaaaataacttagacaaaaacatctaactggttttaatgtttatatatctggtgattttaaatgttgattatcttattgatatttggccatgttctagttactattgatgcataacaggccaccctggggcattaagcaacagtcagtttcttataccagttttgtggcccaagaaattagggctcagccatgagagtgtgtttctgctacccagcactgggggctgaaggctggaatcatctggagactccttactcactcgtatgtctggctcctgggctgggatcagtgcaagtctgggctcacctggcacttgattggagcacctacacttgggctggccatgtagtttggcctctcacagcatgaagacttgattctagtatggagcataccaacagggggcctcttgaaaacgagatggcgctccatggcctcttatgatctggcctcagaaatctcatatcatcatttcaccacactcgatgggtcaaaacagtcactgccacaatatattcaaggccacagaacctacttcctgatcagaagattgtgaacgaacaaactggggaccatacgtttaacctctcattttgcatcctctaaagtatggtgcttgttcaagtccttgggacagaaaaaatttgtttcacttaggctatttttttcttgttgctgtgtagctgttacatatatatgatatgtatgtgtttgtatatattctcttttccccattttgtgaattgttttatctcaatagtacatattaataaacaaaagttataattataatgtaattccatttgtattagtctttttcttttttttggagacagaatctcactctgttccccaggctggagtgcagtggtgccatcttggctcactgcaacctccgcttcctgtgctcaagtgattctcccacctcagcctcccaagtagctaggattataggcacccaccaccacacctggcaatgtattagtctttttatgtctggtttaagaacaattggtttaacccaaggtcaaaaaattattctcatatgtaatattatagaaactatatttctttacctttcacacttaagtctccattggaattgactttagtatatgcattaggaaaaagacaaatttttttccttatgtggttatctgattgatctagtctcatttgctaaaaaggaagaatctttttttctaatttgggtaactatgtatatctggatctgtttctagacactctattctattccattagtctatttttcctatctatctatcccaacaccagaatgtcttaatcactgtagctttgtagctttataatacattttgatatctggtagtacaaatcagcttgccactacacacacacacacatgcacacacacacacacaaaaccctactgagattttcactgggattacagaaaatttatacaaaaattggaaaaaatttacagattataaataatgagtctttcaatccatgaatatggtatatatcccatttatgtaatttctctcaattatgttttatggctttcagtgtagaagttttgcacatcttgattacatttatcctgaagtctgtaatgtttgtgttgctattgcaaatgatattctaaattctaacttttttataaatcttttttctattttttgctagtatataggaacataattatttcacttaatcagcaagcttgctaactataattatttttgacagcttttccaaagatatttttggatttcctacatagccacttacgtctgcaagtaatgaaagtttatttcttcttttctaatctatttagattcctgcttttaatcatttatacatatttcttgccttattgcactgacaagacataatgttaaatatcgcagtagcagccgataacttggtataattcctgatctcaagggaaaagcttttatcatctttcagtttcatacttgtgatttttttagtaatgattattaaaatagagaaaatttattttttttgcgatgtttcatttttaatgtataacagttttctgaaatattaccgttgttttcattgtataggtacatgtacatgtgcacacacagacacatgcatgtgtgtaaatactaatttttatttatttatttatttttattgatcattcttgggtgttcctcgcagagggggatttggcagggtcataggacaatagtggagggagggtcagcagataaacaagtgaacaaaggtctctggttttcctaggcagaggaccctgcggccttccgcagtgtttgtgtccctgggtacttaagattagggagtggtgatgactcttaatgagcatgctgccttcaagcatctgtttaacaaagcacatcttgcacagcccttaatccatttaaccctgagtggacacagcacatgtttcagagagcacagggttgggggtaaggtcacagatcaacaggatcccacggcagaagaatttttcttagtacagaacaaaatgaaaagtctcccatgtctactactttccacacagacatggcaaccatccgatttctcaatcttttccccacctttcccccctttccattccacaaaaccgccattgtcatcatggcccattctcaatgagctgttgggtacacctcccagacggggtggtggccgggcagaggggctcctcacttcccagtaggggcggccgggcagaggcgcccctcacctcccggacggggcggctggcctggcgggggctgacccccacctccctcccggacggggcggctggcctggcgggggctgacccctacctccctcccagacggggtggctgccgggcggagacgctcctcacttcccagacggggtggctgccggacggaggggctccttacttctcagagggggcggctgccgggcagagggtctcctcccttctcagacggggcggccgggcagagacgctcctcacctcccagacagggtcacagccgggcagaggcacccctcacatcccagacggggcggcagggcagaggcgctccccacatctcagacgatgggcggccgggcagagacgctcctcacttcctagatgggatggcggccgggaagagatgctcctcactttccagactgggcagccaggcagaggggctcctcacatcccagacgatgggtggccaggcagagacgctcctcacttcccagacagggtggcggcctggcagaggctgcaatctcggctctttgggaggccaaggcaggcagctgggaggtggttgtagcgagcccagatcacgccactgcactccagcctgggcaccattgagcactgagtgaacgagactcggtctgcaatcccggcacctcgggaggccgaggctggcggatcacttgcggttaggagctggagaccagcccggccaacacagccaaaccccgtctccaccaaaaaaatacgaaaaccagtcaggcgtggcggcgcacgcctgcaattttcgcaggcacttggcaggctgaggcaggagaatcaggcagggaggttgcagtgagcggagatggcagcagtacagtccagcttcggctcggcatcagagggagaccgtggaaagagagggagagggagactgtggggagagggagagggagacggagagggagagggagagggagacggagagggagagggagagggagagggagaatactaattcgaaaatttattttttaattgtacatttttatgggagcttcctgattgaggtatactccacccagtcttaaatctgagctccatagaaactgaggcaaagacagaatcatgactaattacatagccatcattgtttactagaaggaatcatacccaaatgaatgaaagctccatgagaaaaagaacttcacatggagtcttcaatgtcatgtaacaagtgcctagaatagggccaggcaaacagtaaacattcaattaacatttgctggctgggtgcggcggctcacacctgtaatcccagcactttgggaggccgaggagggtggatcacaaggtcaggagatcgagaccatcctggctaacatggtgaaaccccgtctctactaaagatacaaaaaaattagccgggcatggtggcaggcacctgtagtcccagctagttgggaggctgaggcaggaaaatggcgtgaacccagggggcaaagcttgcagtgagccaagattgcgccactgcactccagcctgggtgacacagcaagaatccatgtcaaaaacaaacaaacaaaaacatttgctgaatgaatatcgattatgtgggtcctaagaggactttgttttgcctaaagttctttgttagaagttctaatcaactaataatgacacccttgcagaaattttatttttaaatgaagacatgttttatatttggctgtttcttaaatgagcctccgtgaaagtcatgggcagtagagtaaattgtacttgtgggaaatgcaattgtacttgtacttaatgcaaggccaaagtgatgtagtttgggtttgcagcttattggttcagtacaggtttagtgccaactttccaataactttaaataataaatgctgctcagaatggaataatctattattctaaagcacagttccatttgcttaagaatatgtaaatatcgcaccttcttgtataacttctataaaaagattttgaagttttaattatttaaaggttatatacaaaaagctactttagagggaacttttttataacacggtgttcttttattttccaggaagagagaaaagccaaaaagtaattaaaataatgaaggtgaaagtgattattatctccatagtatctccaaaaacgaaatagaatgaaacacaacgaaaaacgaatttaaacaatacagaaaataattaaaaccttgctaaaattgtttaggttctctggcttccagtgaaaaatcagactaaaggatgaccaattaaatcagtgttttcactgtaggaaatgctaacgtctaaagaggcagaagaagaaaaaaatattttacaggtcagggataagtcatgaaaaggataatagggaaaaaggataaaatagtcaaaaacaggtaaggaagggattaaatgacagtaatactgctcttttagaaactctatttaattgactttgccaccatgaaagctttcatattctccaaatatcactagggagtcctcagaattatttatatatgacttaatgactcataatagaaaatatattcgatataacatgggactctgtgtaaactgggggctttttcagagtaacagcttgtcaataattcatcttgtccatggtcaaatctcgtcaaagttcacctcatggctatacattcgaagttcaaatctctcaccaaaatacaacataaatttcagagaaacagacctgctcttgtatatgtatatatacatatcaattaagtggtgcattttcttttttttttaataatgaacatcgtttattttcataaaggaaaaataccttttttttattattattatactttaagttttagggtacatgtgcacaatgtgcaggttagttacatatgtatacatgtgccatgctggtttgtaatagaagtaacagctgcaagaactatctgacaaggtattataaaactctaacctactgcatcaacacttagtatcataaagctattgtcctgccagtctctcagaggtaactatgaataaaatcaggttaagaattctaccatatcatcctcctattgatgatttgcataggaactatggcaagcagcttaggcactggaatatttcaaataaattaataatgctgaaataagtcaaacaccattttgcttactactgcagaaaatataatgctatgactgctgataatctctgaaagttattcattgtgtataactgaaactgtatatacattgaacagcaactgcctaattccccttccctgcagccctgggcagctaccattctactttctgtttctctgaatttgactatgttagatatcctatatgagtgaaattatgtaatatttgtcattatgctgctggctaatatcaattagcatcatatcctccaggttcatctatgttgtagcatgtgacaggattttcttgtttttttaaggctgaaaaatattccatggtatgcatttaccacattttcttcattcaaccattaatggacatttagtttatttgtatatcttagctactgtgaatagtgctacagtgaacatgaaatcctttctcaaaaaaagtaaaaatagaactaccatgtgcatttccactctgcaatctcactcagattacataacccaaaaaaattggaaacaagatcttaaaccacttttttttaacaaatggtgatttgagtcaagagagtagtaacttgagagatcacatagctaagaaatggtggagttagaaatcagatccagatgtgtctaactctagtatgtattcttaaacaaaacattaataattgtttcagaaataagtaatatatatctttttatcattttttaaaaaactgtgaatgcataatagcagattacctgatgaccatatgagcctgtcagaaaatgaatttgtagtgtctgttttagcataaggaataaaggaatataaatgtacagaaacacttatgtaaatcccattgtgctggcagaattggctaactggaagaaaatgctgaccacttactgcatatcattaaaaaaattaaattttaaatggtttcaagttcaaaatatgaagagtgataattaagaaagtaaggctgatgccatgtctcaagcctgtactcccaacactttgggaggccgaggtgggccgatcacttgagatcaggagttcaagactagcctggccaatatggtgaaacccccatctctactaaaaatacaaaaattagccgggcgcggtgttgggtgcctgtagtcccagctactcgggaggctgaggcaggagaattgaattgctggagcgcaagaggcggaggttgcagtgagccaagatcgcaccagtgcactccagcctgggcaacagagcaagactctgtctcaaaaataaataaataagaaagtgaaaaactaaagagttcaggggaacatcttaaaataatggaatggagcctactgaagcaggatgtgattacaaatgaatttgaattcatttatatgacaatatgaattgggtacttaccatgtatcagacactcttctaggtactagggttatggtatgaacaaagcagacaataatacctgtatgtggaatttatattttactggggaaaagacatgataaatacaataattaagaaaaataatatgaaatggtgattagtgctaaagagaacaaaaagaaaatgggacagagaatgctggagcaggactgatggattttcactgagatggacacgagaagcagtcctgcaatgggacgtttaaacagagatctgaacaaggcaagggagtgtaccatcgcggtaagtggcgaatgagctctcccaggagagaggcgcacatgaagtcctggaggtaacagtataagtaccaagctggagcaaagttagcaatggggaggggctagtatgcacagagctgctcctatattttaatggttgcagagctgccgagaagtccgtgtgcacatatttttcttaataattaataatcagtgttctgaggtctttgtaaaacacacaacttttagcagaatgactgcccagctgaaaagttgagcgttgactacagggatccactcagaggaggaggccaatcccagggcagttcacctcatacccgggcaggctggtctgtaaggtccctcagccctgctgttgactatgaacaactctggaaggtgagcattcgtaagaaatgagcaatgtcggccaggcgcggtggctcacgcctgtaatcccagcactttgggaggccaagacgggcggatcacgaggtcaggagatcgagaccatcctggctaacatggtgaaaccccgtctctactaaaaatacaaaaaaattagccaggcatggtgttgggcacctgtagtcccagctactcgggaggctgaggcaggagaatggcgtgaacccgggaggtggagcttgcagtgagccgagatggcgccactgcactccagcctgggcgacagagcgagactccatctcaaaaaaagaaaaaagaaatgagcaatgtcttctgcaagctatacgtccactctaccagagggtgcctcccctgggaaacagccttcccaggaagccctttatcccaaattcctttttgttcttggacaaagaagagaaggttcaagttcctacttcacacctctccctggcttcagataatggaccccagattgggaatgagattgagaaaaggggaacaagagaaaaaggaatccagaaccggccacttcacaagcagtaacaaccaaatttgaaaggactacagtgttgttgccagtactgccctccgtgggcctccattggcccttccactggtgggccccagggtacttggttcatactcaggctctgagtatgaatggaagggccaatctcttaagcctgacactcttcaaaccagagaaaggaaatcacctgcaccattctttgactggaaaataatcaaagttgaggtattttataaactttaagtttattcttaatattattacaaatactttaagtgtatcaatatatgttctatcaaaaccaatcaacctcattttaaaaagcacattttcttcacaaacatttctgtcatctttaaaaagtctcccttttgagacaggccttgctctgtcactcaggccacagtgcagtagcatgatcatggttcactgtaaccttgaactcctggcctcaagcaatcctctcacctcggcctcccaaagcactgggataataggcgtgagccactgcactcagccaaaatctctttttttttttttttttttgagacagtctcgctctgtcacccaggctggagtacactggcgtgatctctgctcacggcaagctccgcctcctgggttcatgccattctcctgcctcggcctcccgagtagctgggactacaggtgcctgccacctcacccaactaatttttttttttttgtatttttagtagagacggggtttcaccatgttagccaggatggtctcgatctcctgacctcgtgatccacccgcctcggcctcccaaagtgttgggattacaggcgtgagccaccgctcccagccaaaaaatctcttttaaatgtactcgtctgagcagctcatcttagccctctgagaaagccaatacactgttacagaaatcaaaactctctctcctttgttcatgacctaggacaccaagaatcaatcctgcttatacatacagtcgatcagttatagaactttgttttagcctatttccccctacacaccacacaggcttctgactcagttttgctctgtgtggaagaatttcaatccaaatctgttggggtatggtagcaaggccatgttttccaattctttggaagttggtggtaactaaaatggaaaagagattcttagcacaaggaaaattagagatttgattagctatatgaaatttagtcaatcaaatattccatggtatgcatttaccacattttcttcattcatccatcaatggacacttagtttatgtgtatatcttggctactgtgaataatgctacaatcaacatgaaaccctttcttaaaaaaattaaaaatagaacgaccatgggtaattctactctgcaatcacactcagattacataacccaagaaaactagaatcaagatcttacaccactttttttttaacaaatggtgatctcaagagaggaaaagttcagattcaaacgactcaaagaggtaaatttgtaggtaaaaaaaaactgagggcctcaatatgatagtttctcttccttgtgctggtaccgtgtacagcagtgtggcatgccatatgacaaaggtgactgaaaaacaaattccaatgctacagtgtccaggacctagctcattctttatagtctgtgatccacatcaccaccacaaagttcatccctgcactttgaaggtcccaacttatgtaaattccacacatcacaggacaataaaaacaagttattctaaatacttagaagggaggaaagaatacaaagtatgaaagaaaatatgttggccgggcgcggtggctcacgcccgtaatcgcagcactttgggaggctgaggcgggcagatcatgaggtcaggagatcgagactatcctgactaacatggtgaaactccttctctactaaaaatacaaaaaattagccaggcgtggtggcgggcacctgtagccccagctactcaggaggctgaggcaggagtatggcgtgaacccaggaggcagagcttgcagtgagcagagatcgcaccactgcactcgagcctgggcgacagagcgagactccgtctcaaaaaaaaaaaaaaagaaaatatgttatgcacatttctttccagttatagccagtgacagctcttctactggatcagctatcgattgccacaacaaagctgcataacaaacaaccactcaagctcagtgctctcttggcagccacagaggagctagagaggaagtggaaatatgcaagggccttgttgaggctctgtttttgtcatgtctgttagtatccctttaccaaagcaatgcacatgggcaaggccagtgtgagaatgggaaggcactgcaaagtcacgtgactgagggcaacaggcagaaaggaatgatcagatgcttaacgtgttactatatttcagttattgaatactcatttgattattgtttttagattcaatctcttaatgatgttttccaccttggcatctatcttcctgaatatactaatcactattatgtcagtctgcctctgttaacttcaatttctggatcaactctgcatctgtttctattatctgttttttcttggtcttataccttagaatgcctaatagttttctggttctttctttaatttaataactgatgttgtggatgaaaaaatatcaattcattagagagcattatcttcttttagaatgaatttttgaggcatctggcagggcagttatgttaagggaaatttccatcatcttaacacaatgaggcatggggctggtttgagattggatttcagtctttctaagtcctaatataattcttatttcccctgactcctatggtgttgtccttctggcagcacaactaaagttgagggtaattaccagtgaacttcagaatccaaaattccaatgttcaccttttcagcactcatgagacagctaatagttcagctgaaattttctgacttttttcacttggcatcattccctagaatgatgttccatagaaattgttgtgtacatcattgttcatttctttgtattactgagtagtattccatgttatgggtgcatcatagtttgtgtaaccattcacctattgaaggacattttgactgtttccaatatttggctatttcacataaagttactatgaatgcttgtgtacaatttttagtgtggacataagttgttatttctcttggatgaatacccaggaatgcaactgctgagttgtgtagtaagtgcatatttagttttatcagaaactgctgaatgattttccagagtggctgtgtcatttttaacttccaccagcaacatctgagtaatccagtttttctgcatcctcaccagtacctggtgtcatcaacattttttattttagtcatgctgataggtatatagtgacatctcattgtgattttacttttgtatttctctaatggctgttagataactttttgtgtgctattaatcatctatatatcttcatcagcgaaatatctgtgcatttcttttgcccatttcccaattggattctttatgttttactgcttattttgaggcttctttatatattctaaatactagtcttttgccagatacgtgagttgaaaatattatattactgtctgtagcttatcttttcattctctttacagggttttaatttgataatgatcaaggattttgactcctaggtaattcctcaagaagctacatatctaatagaacctaattctacatttgctaggggacacatgaaagagtgttccaagcagaaccgttcacagtacaaaaaccctagagataatatgtccactgacacaagtaaatgagtaagtgctaagatattcacagaaaggaatcgtataaaggaatcaaagggaataaccaaccatgtggttgaattttagaaataaactattatatttctaaatataatataatatatattatatttctaaatataatataatatatattatatttctaaatataatataatatatattatatttctaaatataatataatatatattatatttctaaatataatataatatatattatatttctaaatataatataatatatattatatttctaaatagtatatttagaaatatactattgagtggggaaagaagattgcttagtatatgttttctataaagttagaaataaaatatattggcaaaattatagaagcaacaaaaatacataaataaaaatgggttaattaacaaagtggtgggatgactgttacttttggtgggaagaagagaaggttttgaaatgtagggggactataaagctaaatgtaaattatggccaggttaaagcaatgagtagtagactcacaggtgcttcttaccttaacaagtaagcagtctgttgaaaaaaacaaaaaaattaagtaaaccagcacactaaattcagtgtgttgtgaacatgagtcacattcaaaaatttttaaggggaagaaatagcaaatacatgatttcagttttatgtggcattagtttattatgagatggatgaatggatggatggatggatggatggatggacggaggacaaaatggaaagattttagtgtatcagttactatttattgcctacctgacattcaaagctgcttctttctttctgacatgatattgattttttttttaggtatccaccctcctttatttaactcatgcttgcttcacagattctaaaaggcaggtttggattccttttatgtgttcataagggccccactccctttgcagctaattgatgtagacaagcaattaagtggttcttgctaaacagatttgaatgttactctactaagaatcttctgaaaatgtatcttcattctttttttttttttttttttttttttttttgagacagagtcttgctctatcgcccaggctggagtgcagtggcacaatctccactcactgcaagctccgcctcccgggttcacaccattctcctgcctcagcctcccaagtagctgggactacaggtgactgccaccacacccggctaatttttttgtgtgtgtttttagtagagatggggtttaccatgttagccaggatggtcttgatctcctgacctcatgatccgcctgccttggcctcccaaagtgctgggattacagacgtgagccactgtacctggcccccagtatcttcattcttaagaaggtacattattttattttttgcctatcaatgcttcctagcctggaggatatgaaaatatatctaaatcaactgcaaggaccatgccacctttagagagtgatctagaagatcaagcccacacattgagtttggcagagaagaaagagggccttagccttactgaactgctggacttaaaaaaccttggacctaacctgcctttgcacttattttgacatttactttcctattaatccagttgattttttttaacttacaatgtagatatatagatgatacataaatcactttaaatgacaggttagaaaacatttacttcaagtagccatattatatggtgaatactgtcaaaagattcaaaatcattatgtgatgggcctggccaagacaatggtatgcatcagggatctggaagaaccagcacattcaaattgggcaggctgagaccagcttacaaaggtctgggtaggatgcagggaattcccaagtgatatggttcggctgtgtcctcacccaaatcttatcttgcattgtagctctcataatccctgtgtgtcatgggagggacccagtgggaggtatctgaatcatgggggcaggtttttcccatgtcgttctcatgatagtgaatgtctcactagattggatggttttataaagggcagttcccctacacatggtctcttgcctgccgccgtgtaagacatacctttgttcctccttcaccttcctccatgattatgaggcttcccccgccatgtggaactgtgattccattaaacctctttttctttataaattacccagtctcgaggtatgtcttaatgcagtgtgagaatgaactaatatagtaaactggtaccagtagagtgtggtgccgctgtaaagatacccaaaatgtggaagtgaatttggaactaggtaacaggcagagggtggaatagtttggagggctcagaagaagaaaggaaaatgtgggaaagtttggaacttcctagagactgttgaatggctttgaccaaaatgttgatagtgatatgcacaataaagtccaggctgaggtggtctcagatggagatgaggaacttgttgggaactggagtaaaggtcactcttgctatgcaaagagactggtgacattttgcccctgccctagagatctgtggaactttgaacttgagagagatgatttaaagtatctggtagaagaaatttcaaagtggcaaagtgttcaagatgaagcagagcttaaaagtttgaaaaatttgcagcctgacaatgcagcacaaaagcaaaacccattttctgaggataaattcaagccagctgcagaaatttgcataagtaacaaggagccaaatgctaatcaccaagacaatggggaaaatatttccagggcaagtcagagacctttgcaacagcccctaccatcacaggcccagaggcctgggagggaaaatggtttcctgggctgggtccagggcccgcctgctgtgtgcagcctttagacttggtgccctgcatcccagctgctccagccatggctaaaagggccaaggtacagcccaggccgtggattcagagggtgcaagccctaagctttggcagcttccacatggtgtgttgagcctgtaggtgcatagcagtcaagaattgaagtttggaaacctctgcctagatttcagaggatgtatggaaatgcctggatgtccagacagaggtgtgctgcaggggcagagccttcatggagaacctctgctagggcagtgtggaagggaaatgtggggtggaagcccctatacagagtctccattgggcactgcctagtggagctgtgagaagagggccactgtcctccagaccccagaatggtcgatccactgacagtttgcaccatgaacctggaaaagccacagccactcaatgccagcccgcgaaagcagctgggaggggagctgtgccctgcaaagtcacaaggatggagctacccaagaccatgggaacccacctcttgcatcaatgtgacctggatgtgagacatggagtcaaaagagatcattttggagctttaagatttgactgccctgctggattttagacttgcatggggcctggagcccctttgttttggccaatttctcttatttggaatgggaatatttattcaatgcctgtacccccattgtatatagaaaataactaacttgcttttgattttacagactcataggcgaaagggacttgccttgtctcagatgagactttggacttggacttttgggttaatgttgaaatgagttaagacattggaggactgttgggaaggcatgattgtattttgaaatgtgaggacatgacatttgggaggggcccagggaagaatgatatggtttggctatgcccttcccccaaaatctcatcttgaattgcagctcccataatccccatgtgtcatgggagggattcagtgggaagtaattgaatcatgcgggcgggtttttcccatgctgttctcatgatagtgaataagtctcatgagatctgatggttttataaagggcaattcccctgcacatgctctctgtcttgccaccatgtaagatgtgcctttgatcctccttcaccttcctccatgattgtgaggtctccccagccatatgtaacagtgagtccattaaacctctttttctttatacattacccagtctcagatatatctttattagcagcctaagaatggactaatacaccaagagagagtataatgccccagggccagggccactgtgacctgtggtaacaatggatgggcacagttactgggacctggagcacagaacatgtgtcaagatgccagttgtcaggagctgtgtggcagttatctattccacaataaaactggggatatcaatatccacaagatatcaataaaattgattatctcacagtttctgtggttcaggaatctgagaagggcttacctggaggcctctggctcagtctctcaaaagctgccatcaagtcacaggccagggtcatctcaaggctcacctggggaaggatcctcttctaagctcacacatgtggttgctggtatttggaaatggagtccttggaggttataggtttaggcgaggtcatgagggtgggaccctcatgaatggggttagtgtccttataaaaaggaataccagcaaattctctctctttttcccatgtgaggacacagcaagaaagcagacatctgcaaatcagggagacagccctcagcagacacaagacctgttgacgccttaatcttggacttcccagccttcagaactgtggaaaataaatgtttgtggtttaagccacccagtctatgatgttttgttatagcagcctgaattgactaagacagataccttgaaaaccaccatcccctgctgagcaatattgttctgctccttaggctgatttcagttttctttcacttagcatttcataactttaatttgcttgttaaaaaatttatctggatcttttattccctttatcctaaacttcaaaccacccactttcttttgcaagttttctgtttgacaccattcacttccttttctttctccttcattcatttctccctttctccctctttccctccctccctccattccttttgtcctttcttccttcctttcttctttcttcctttatttttttcatctgactctttccctggcaattgtccttggctccttcgtttacagtagtcactcttgatggtgagcattttgaatctccaaatgactatgaaatctttttatttctcattagcgcatgcaggtagtacatgtgtttcagtaaaattgaggaagcctggcagacactctgtggtctctgctgcattttctctggaatagctacagctctgtgtagcaatatggttaaggcaccatattgtgtgaaggcccacctagcctgggcatcactgtatctctgtcttcctaacaaaatgaagtggaaatttcaaaaaaatcaggagatggaacaaaagttttctcatgttttttactgcttattaaatgaacaacgaacaataatccaatgttaaatgtaaagttttcagccctctgcctgaataggctcacctagttatttgaacatgcctcactccaaatcttgtcctcagcaactgtggataaatcatgacagagaagttcccctaacctacagcagaggctcctcaagctatgccaccctactgatatagaagtggagaaagagtgctgggcgtggtggctcacgcctgtaatcccaacactttgggagtctgaggcagcggctcacgaggtcaggaaatcgagaccatcctggctaacactgtgaaacccggtctctaataaaaatacaaaaaattagccgggcgtggtggtgggcgcttgtagtcccagctacttgggaggctgaggcaggagaatggagcgaacccgggaggcggagcttgcagtgagccgagattgtgccgctgcactccagcctgggcgacagagcgagagtccgtctcaaaaaaaaaaaaaaaaaaaaaaaaagaaagagaaaaagaaaaaaaaataatggagaaagaggtgttctggcccatttagttacattttccagggcaaaaatcacggatacatggtgaaattcaactatattctctgcccaagataaaatccaattacagcctctgctcaatgaggaaatcccatcacaggttccttttgcttcactaggagacaaagagacaagtttgtttataatctatttatagaggcatacacaccttaaaaaaaagtggtcctcaagtaggagatttgcatttgttggtcattttatttctgggcagatgttcagtctttctaacttgaaaagtgtctagcaactttggctgaccttattaagattaatggtcataatgtatttaaatcccctgttgttctaagaaggattaaacaaaagttatgggaggcccttgttttagactgagctattacaaattgggccacaagagaccagactaaaccaaaatggagtcactcatgctaaataccatataattaaactggaactctaaggaaacaggtagatcccacatcagacttgtttttcctgaaatcaggggatacaagtctgagtcagtatactaaaaaagtcccctctgctttaacgcttatgaacaaagtaacctgcaggaacctgaagttaaccagtcagcttttgttctattgttctacttccttgttctcagtatgacctctcattctattttgtagtatggaggcatctctgattaacaaatcatgagaagaaagccaattagataaccaaataattattatctcttactgaaataactcccaaggacctttggcaagatctagcactaaccaaattttcccagaaaaaaattttgggaaaggactatttgtggattgtaaaccactactagggcagatcccaactgattagagatggattttgaggatgcactcaagaaaaagaagcacaagttaaagtagtacctgtcacctgtgctttttccaaagaaggttttgtgaacttcaatatttaaacaggaaagagtaagaaggagtggaagaaacaaaaggagggagggtaggcattgatgcaagtggtgaggcattgattagcactcagtgaatctatattttacacatgcaaagaagggcgtagaggaaaaagtcaattatgcattcatttcatgctcagtaaatctatattttccgtaagataaagcaagcatgtgaaatcatggttctttctgtttgggaacaaaaagaaggcagttttatgcgtgactcagttcccactcttaacttttcgctttggcatagtgagacgggagtcctaagacgttatttatttatttatttatttatttatttattgacggagtttcactctgtcgcccaggatggagtgcagtggtgccatccctgctcactgcaacctctgcctcccaggttcaagcgattctgttgcctcagcctcctaagtagctgggactacaggcacctgccaccacacaggctaatttttgttttttcagtagagacaaggttttaccatgttggccaggctggtcttgaactcctgacctcaagtgatctgcccacctcggcctcccaaagtgctgggattacaggcttgagccaccgcccctggcccagccaaggatttatttgtgcctgcagatagctgtatgaacagacacctgtaagaattgggggaattcctctcttctcaatgttccaaagtaacttgaggttccgggccattcaaaggtgaaattttttactcaccacaggtcaggagctttgtaaaggaattgcatgcagagggtaccatgccagtttttccaaggggtttttctcagcccttaaagtcaattttaattcctcaaagcagtctggttatttctgaaaaaatgtcattccagtcaaagacttgataaaatatccaacgtctccaattgggttctgttacaagagaaaacagattcttattgaacttatgcaaataattatattgccataaattaaggattgtcaaaaatagtttccaaattcggctgggcgcagtggctcatgcctgtaatcccagcactttggggaggccgaggagggcggatcatgaggtcaggagatcgagaccatcctggctaacacagagaaaccccgtctctactaaaaatacaaaaaaattagccgggcgtggtggcgggggcctgtagtcccagctacttgggaggctgaggcaggaaaatggcgtaaacccgggaggcagagcttgcagtgagcggagatcgtgccactgcacttcagcctgggtgacagagtcagagtccatctcaaaaaaaaaaaaaaaaaaaaaaagtttccaaattctggagaaatcaggtaaaagaaaaagaaacgtggctgggcgctgtggctcacacctgtaatcccagcactttgggaggttgaggcaggtggatcacaaggtcaggagatcgagaccatcctggctaacatggtgaaaccctgtttctactaaaaatacaaaaaaattagctgggtgtggtggcgggtgcttgtagtcccagctactcagcaggctgaggcaggaaaatggtgaacccgggaggtggagcttgcagtgagctgagatcgcaccactgcactccagcctgggtaacagagcaagactccgtctcaaaaaagaaaataaaagaagaaaaagaaaaagaaacgtgtttcagattctggtcataagagtatactttactcaattgttaaaaattataaatagatcaaaagaaaaaagctatctttttaaagtaatttctatttttattttagattcagggggtatatgcacaggtttgctacctgggtatattgcatggtgctgaggttttgggtacaaatgttcccatcacccaggtagtgaatataatactcagtagttttcaacctatgcgtcctccttccctcctacctctagtagtccccagtgcatatcattgccatctttatgtccatgagctcccaaatgtttagctcccacttgtaaatgagaacatgtggtattcagtttcctattcctgcattaattcacttaggatagtggctgcatccatgttgccgcaaagaacatgatttcattttttatggctgcatagtactccatggtgtatatgtaccacgttttctttatccaatccactattgatggacgcctaggttgatttcatgtctaaaagttttcttgactgaaaaaaaaaatcaacaatgcttcaaacaaaaagggttataaaatatatttcagtcctctgttagttcagttctatgaaattaattcatttcatttgatattgggattagtaatcctcatgaacacagtagctctacaatgagagttctggaagtttgtttctctactctactgatgaaatctccaaggttgtcagaaacttacatttgaagcacccatcagaatcctttctgtgaactaccctaaagaagcaagttttggactatagctgattattaactgctttttgagaagaatcaaataaaataataattgtctgtggatgacaaaagttttaggacagccatggttaaagataaggaaatttggttatttctgtgtcatactaaaatttaacttaataatacttattttgattattatgattatcagacaaatcagaactataggatctcattgtgccacggcattccgcctgggtgacagaatgagactctttctcaaaaaaaaaaaaattataagatctcatacaattttggaacacatgttaataacacacttatgtaagtagaacccaaagaaacttaaaaaccatttcatatttgaatgtttcctatatgattttaacatatcgaataagccaaatgtgtttcttttagacttcaggggacctattatctaaaaaagctaatgaagtaaaaaaaatactgaattacaattgaaattttaatgtttgaaagtttctcaaatgtcaaatgtttaaaacactctacaccgcaagatagaattacaggtcactataaaataaattattcacttagccacaatcataattcaaagactttaaaaatcattcactttttgatagagcagagactcagtttcccaaacaatatgacctaataaagatcgaatgaggcgaactgaatatctccctctctccctctttattttatagtttactcaagaggtaaacaaaaatctttctttatcaaaatagaaaaccagccgggcgcgatggctcacgcctataatcccagcactttgggaggctgaagcaggtggatcacttgagttcgggagttcgagaccagcctggccaacatggcaaaatcctgtctctactaaaaatataaaaattaggcagacatggtggcaggcgcctgtaatcccagctactctggaggctgaggcaggagaatcgcttgaacctggcggaggtttcagtgagcccagatcaggccactgcactccagcctgggtgacaagagcgaaactctgtgtcaaaaaaaaaaagagagagagaaaaccaaattttacttttacattagtgtagcattaacactaaagataatttttttttttaaatttagagacagggtctcgctatgttgcctaggctggagggcagtggctattcacaggcccatcccattactgatcagcacgaattttgccctgccccatttccgacctaggccagttcacccctctgttggcaacctggtagtcccctgctcccaggaggtcaccatgctaaaactaatttttaatgaaaccttataaacaaattcatccaatcttaataagtttgatcataaggtaagatttccataaacctctcatagcctgttatagttttctattaaagaacagattaatgctccaaggaaaccattgttgtcacacaggagcccagactgtggcatcagtgtgcttttgatattaatcctgaatttatagaaaaactaaataatatcttttaaattttagccaacttgatcacacacagaattccttttacaagatctgtcttccacaaaccttcttcaatttcctaacacctttagccttatcctatcattctgccttagcacaaaaatttactttcttttcaactttctatatccgtttagtttttagttttattcatcttttttcctcttttaatttaagaaaacctctagactaggcaaaattacttcccctttaagagaaaacatatttccatgccttctcataagctttttaccaaaacgtatctacttttctaagtttgcatattaaattgtttcttttatatctagtagttttcactacatacattgattatgttaactgttagtaactcttatttttagtgaaaaacttaggaagtaatttttactgtgtactagatgcagagtccagaacaaaggacaatgcctggaaatagggcttgttatattttagaggctcaaatctaaaaccataagtttatttaagagttatgtatcaaaaattacataaaagcaagttttgaccttaaaacatctagcagatatagtatcaaaccagtagaccaatagtctcagacaaaatgtctaaattctgaagatgtttccattttattttaccaataattttaaaactgtctttatttactaaagattattaaagtcacatgaactaaaaggcatttaagtttctatttttatgataaaatatttgatttaacacattttcattaagccaattagagtgctttcatattgaaggaagaccctctcatattattttatattgttttatactcagtacctgttttaagaaaaaacaacaaggaagtaaaaccaaagacaggcagcccagcgccaggcccgaaaccaggcctgggcctgactggcctaaacccagtagttaaaaatcaactcataacttagaaaccgatgttattcatagattccagacattgtatagaagaacactgtgcaactccctgccctgttctgtttctttctgaccaccggtgcatgcagcccctgtcatgtaccccctgcttgctcaaatcaatcacgaccctttcatgtgaaatctttagtgttttgagcccttaaaagggatagaaattgtgcactcggggagctcggattttaaggcagtagcttgccgatgctcccagctgaataaagcccttccttctacaactcggtgtctgagagggtttgtctgtggctcgtcctgctacaatatattttggtagtgaaacatcacatacacatacaacatataaataaatagataaacagaaacatagaagcagttcttacagatgtataagatttttcatccatcagttttaaatagttcggtttttttaattcatcctacaatgacctgttttactgccctaggcaattgttagctaggcaaccctaaatttgcatttctaaaggagaaaatttgcatctcaaagtatagaaagagactgggaatttaagctttttttaaaaaaaagaaatttggctgtgctagaggacaatttgaaaattaatgccagggtaatacaaaattatataaatgtattaaaagattttataaggagatcaatttcctttacataggtctctaccttttaactggaccgctgaacttaggacagagcccacactgaattttaggtctgcaaaaagagacatgccatggggacgggaccatacaatgttttcacagtgcatttcatcacaaagacattccccttgggcaacccaacaccaatcagcccattctgtgatctgcccattccctagccattatacacaccagagtcaagtttttcaaaatacaaaataatttctgttaccaccccgcccctcaaccaaaaagatcaggtaatgcaatacaaaagagagtagagttttagatacgagaatactctgttgcagaaggtagtcaggcagacatgagcagggcaggagaagggccccccaccaggattgtcaggcaaccatcaagtgatggtcaggcagttgttaaacagtcgctctaaaataataattggttgcagctggcgccagggaacgacaatctcccaataaatagaaacacctgtaactagtgatcagcagcttccaaataagatctcagaagttaggtgtgtgaaggaaaaatatcttgggtcccttcaagatgtgaaccgctcagggaaatctgcctcctattctgttcaagtcatccatttgctcacagagacagatgcatattctgattgcctcctttggaaagacttatcagaaactcaaaagaatgcaaccatctgtctctcacctacctgtgacctggaagcccccagtaggggggccttgctttgagctgtcaccgcctttctggacggaactaatgtacttcttatatattgattgatgtctcatgtctccctaaaatgtataaaaccaagctgtggccggaccaccttgggcacatgtcatcaggacttcctgaggctgtgtggtgggcgcggcctcaactgtggcaaacaagctttccaagttaaccgagaccactctcctaaggccttgctttttttttgagcaaaagtttgcttttgtattcttctcagttgactgaattctgttttcacctgatgttttgactaaaatagtattgcaacagaagctactcttggatttttaaagaagaatgtagtttagacactcaaaaatgtctttaaaaaaaaaagtacactgtaaaagcatctccctctagcactaccagacgtttttttctgtaccttatgatgtaaattttgctatttgattttcacctgagttgtttcctttaatgtgcaaatttaaggctatttagctgacaactgcctagggctgtgaaaccagttatctggaatctgaaagtctaagacagaaaaaatgcaaaatgcaggggtcttttgtcgtttttttgtttttggttttttttttttgagacaaagtttcactcttgttacccaggctaaaatgcaatagcaccatctcggctcaccacaacctcctgggttcaagtgattctcctgcctcagcctcctgagtagctgggattaccagcatgtgccaccatgcccagcttttttttttttttttttttgtatttttagtagagacagggtttctccatgctggtcaggcttgtctccaactcctacctcaggtgatccacctgcctcggcctcccagagtgctgggattacagtcatgagccaccacacccgactgggtctttataaatctataaaatgtacttccatctgtatgcctaatacgtctttttgtgtatttatgtgttgtatacaaaatgtttcactactaaaaagagctctagttaattgacataaaaataaaagtgcttaaatcaaatactaaaaaatgactagtcaaatgctttttcaagtttatgtaacaaataaaatctttaataaataagctagctttaaaattattggcaaagtaatattagaaatgtgttaagaattgccagcagacatttttgtttgtatttgttaatcaagcaatttcatacttacccccaccaaatactataaggtgtcaaaatttggcataagggttataaaacccaacccaaatcagaatgatctttgcttgtgtaatttttaataaataggacattgacatgggtataatgaaaatagctgcatcttgaatttagcaagattactataacttctaatcctgcggctgtaggcagtctaattcacagacaatgggaaggtttgttgggaaagggctgttatcatctttgtttcatagctaaattgtaaactaagttcctcccaaagttagttcggtctatgcccaggaatgaacaaggacagcttggaggttaagagcaagatggagtcaattaggtcaaatcttttttttttttttgagatggagttttgctcttgttgcccaggcaggagggcaatggcaccatctcggctcaccgcaacctccacctccaggttcaagcaattctcctgcctcagcctgcctgagggaagaaagagaccctctcatattgctttatactcagtagctatttaaataaaaaaataaggaagtgaaatcaaagacaggcagcccagccccaggtctgaaaccaggcctgggcctgcctggcctaaacccattagttaaaaatcaactcataacttagaaaccgatgttattcatagattcccgacattgtataaaagaacattgtgaaacgccctaccctgttctgtttctttctgaccaccggtgcatgcagcccctgtcatgtaccccctgcttgctcaaatcaatcacgaccctttcatgtgaaatcttcagtgttgtgagcccttaaaagggacagaaattgtgcactcagggagctcagattttgaggcagtagcttgctgatgctcccagctgaataaagcccttccttctacgactcgttgtctgagaggttttgtctgtggctcgtcctgctacatttcttggttccctgacagggaaacgaggtgactgatggatggccgaggcagccccttaggcagcttaggcctgccccgcggagcatccctgcaggggactccggccagcctgagtgacgcgatccaaagagcgctcccggttaggaaattgcccccattggaacgccttgccagagcagcacgtagcaggcccccgtggaggatccacacagtggctgaacactgggaaggaactggcgcttggagtctggacatctaaaagttggtaagactagtctttggaacttgccccactccatctgagtggaagcgtggcttgatcacccacggtgtgcctgcattggcacttttgttctggatttgacttgatttgaattgctggatactttggtttggttttggttttgacttggcttgaattttttggtactcggattttgaatttcgtgattttggtttggcttaaacggtaaaagtgtgtgtttgccctctttgcccgttctttgtcttgtggtgagtgtgtgtggtgtgagcgtggtattctgtcttggagaaaaaaaaaattttttcaagaaagaacttaagggagattacagtgctactgtgacaccaggaaaacttagaactttgcgtgaaacagactggccagcattaaaggtgggttggccatctgaaggaagcctggacaggtcccttgtttcaaaggtatggcacaaggtaacctgtaagccaaggcacccagaccagtttccatacatagacagttacagctggttttagacccccttcccccctacagaagttaagagaacagcagcatgagcagctggcagaggcaaggaaagaccagcagagagaaaaaaaagaccatctataccaattctaggttaatttagactaaacaaggtcttattaatagcaaaggataattgaaatcccaaacttacaaggttttcaacaaaagtgaagtttgctaaaagttaaaagtgtagcatgtattatggtaacttctaatcttgtggccttagacagtctagtccaaagacataaagaaaattcgctttaaaaaaggggaaaaaaggggggaggcagaatttatataaaaagaatgttatatggtaaattcttgtcctgaaataaattaactgattgtttaaagaaaaaaagtttgtaataagtcagaaagttaagacatgttaaaaaattgtctgtgaaagttgtgaaagaaaaaatgttatcaaaaattttatgcaaaaaatgttgtataacttaaaagtaataaggcctcctgagtactactgaagaaacagtttatgtgcaaggtgtataaaaaaatatacctttgataaaaagattataaggaggcataagaatgtgaatttttacctacattaaaaggttaaaaaaatattgttttaaaagtttaagcaagttttaaaacgttaattgtaaagaaaattctgtgtgtaaacatattaactaaagttaaaaaggtatcatccagtttttctgtagactagacattaaagtaaaaatgcaacagatttttcttaaagcatcaacctgctctttaacaaaaattataaaaggttaaagagtctataaaatcttaccttatagtcaaacatgaaaaattggataaatatgtctacaaggttttattaaaattaagtttaacattaataacacactaatataaagataaaatttagcttctctggtataaaaatcatacaagaagcattattaaatataaaatggtgtttagctttctttggtctaaaaactaacaaaaataggtgctaaaggaagcattcattttactaaaggatcatagaagttaaagacttaaaacaaactttggcaattaagacaggataccaagatgcaaatgcctggatgaaatggatcaaatattccatctgcacgttaaacaaaagcaattgttatgcttgtgcacatggcagggcagaggctcagaatgtcccctttccactaggtggtcctccagtcgaccaggtgtgggctgcatggtagctcttttccaggattctacagcctggaataataagtcatgccaagctctctctgctatattccgaagtccctgggggcagccaccgagggccatccagcttccatctcccaacactaacttcacttcgtgtctctcacggcagggaggagacttagcattccttggagacctgaagggatgcagtgagcttaagaattttcaagagtttatcaatcagtcagcccttgctcatccccgagcggatgtgtggtggtattgcggtggacctttactggacttactggacactctgccgaataaccagaagtggcacttgtgctttagtccatttggctatccctttcaccctggcatttcatcaaccagaggaaaaaaaaaataagacatcataaagtgagagaagccccttatgggtctttcaactctcgtatatatttagatgcaattggagccccgcaaggaataccagatcaatttaaagcttgaaatcaaatagttacaggactgaagtcaatattttggtagatgacagtcaataaaaatgtaaattagatacactacatctattacaaccaacagcaacgagcttttcatgagttaaaaagaaaaactcatgtcggccccagccctggggctacctgacctgacaaaactctttacactccatgtgtcaaaaagaaaaaaaatggcagttggagttttaacccagactgtagggccctggccaaggccagtggcctatctctcaaaacaactagatggggtttccaaaggctggcccccatgtctaagggccctggcagcaatggccctgttagcataagaagcagataagctaactcttgggcaaaacctaaagtccccccatgctgtgatgattttaataaataccaaaggataccattagctaacgaatgctagactaactagataccaaagcttgctctgtgaaaattcccgcataaccactgaagtttgcgacaccctaaccctgcacaccttactcctggtatcagagagcccagttgaacataaactgtgtagaggtgttagactcagtctaccctagtaggcccaacctccgagaccaaccttaaacatcagtagactgcgagctgtatgtggataggagcagtttcgccaacccctgcaaagtgactctgaaaaagacgacaagccctgctccagtcgcacccggaagctgactggtccacgcacggccaaaacatgaggaaactcatcgcgggactcattttccttaaaatttggacttgtatagtaaggacttcaactgaccttcctcagactgaaggctgtttccagtatatacatcaagtcactgaagtaggacaaaagattgctacagtcctattattttatagttattatgaatgcctaggaactccaaaaggaacctgtttgtataataacacccaatacaaagtatgtaatccaggaagtgaccagcccgatgtgtgctatgacccctttgaacctcctatgatcacagtctttgaagtaggactgagaactggtcattctctaagtgacacaagtaaagtaatagctagaacagaagaaaaaggggtcccaaaaatgtaaccttaaaatttgacgcttgtgccactattgatagtaagcagcatggaataggatgcggttctctaaattggaaaaaaaagttacacggtaaaaaaaaaaataggtatatctgtccagaatcatatgtgagatgtgtcaatactggtcttgtgtcatctgggctacttgaacagaagataaaaaagatcctgtttggctccaaaaaggaaaagtcagcccctcctgcacaagtgggagctgcaaccttttagaaatgataatcacaaacccctcagaaccagaatgtaataaaggaaaatatgtatctttaggcattgatggaaagggactagatcctagcgtgaacatcctaataaaaggagaggttcaaagacactctccagaaccagtatttcagactttctatgatgaactaaatgtgccagtaccagagactccaggaaaaatcaaaaatttgtttttgcaattagccgagcacgtagcccagtctctaaatgtcacttcatattatgtttgtaaaacaactgtaataagagatcaatggccataagaagcctgagaattagtgcctacagacccagttcctgatgaattctcagcccaaaagaatcaccctgatcatttctaggttctaaaagtttcaattattggacaatattgcatagctagaaaaaaaaaaagaattcactcattctgtaggatgacttagttgcctaggacaaaaactataatagtaccacacacacacaaaacagttacatggtggagctccaattacacagaaagagatccattcagtaaatttccaaggttgcagactgtctgggctcacccagaatttcaccgggactgggctgcccccaccgggttatactggatatgtggacacagagcttatgctaagctgcctgatcggtggacaggtagctgtgtaattggcaccattaaaccatctttctttttactgcccataaaaacaggtgaactcctgggcttccctatctatgcttctcatgaaaaatgaagcatagccataggtaattaaaaagatgatgaatgacctcctaaaaaattatataatactacggaccccccacttgggcacaagatggctcgtggggatatcggacccccatctacatgctcaaccaaatcatatggttacaagctgtttcagaaatcatcactaataaaactggtcaagccttgactattctggcccggcaagaaactcagataaaaaatgctatctatcaaaatagattggctctcagctacttgctagcagctgaaagagaggtctataagacatttaaccttactaattactgtctatacatagataatcaaaggcaagtagttaaagacatagttaaaaatatgacaaaactgacacatgtgcctgtacaagtgtggcacgaatttggccctgaagccatgtttaaaaattagttcccagcactaggagaatttaaaactcttataataaaagttataatagtaataagaacctgcttactgctcccttgtttactacctgtacttcttcaaatgataaaaagcttcatcactaccttagttcaccaaaatgcttcagcacaagtgtactatatgaataactatcaatttattgcacaaaaagacataagtagcaaaaataagagtgagaactcccactaataaaaagtgagagtctcaaagggggaaatgagggaagagagagaccctctcatattgttttatactcagtacctgtttaaagaaaaaaaacaaggacatgaaatcaaagacaggcagcctgatgccaggcccaaaaccaggcctgggcctgcctggcctaaacccagtagttaaaaatcaactcataacttagaaaccgatgttactcatagattcccaacattgtataaaagaacattgtgcaactccctgccctgttctgtttctctgaccaccagtacatggagcccctgtcacgtaccccctgcttgctcaaatcaatcacgaccctttcatgtgaaatctttagcgttgtgagcccttaaaagggacagaaattgtgtactcggggagctcagattttgaggcagtagcttgatgatgctcccagctgaataaagcccttccttctacaactcggtgtctgagaggttttgcctgcagcttgtcctgctacatcccaagtaactgggattacagcatgcaccaccatgccaggctaattttgcattttttttctttttttttttaaatagagacggggtttctccatgttggtcaggctggtctcaaactcccaacctcaggtgatccacccacctcagcctcccaaagtgctgggattacaggcatgagccaccgtgcccggcctagatcaaatcttttttcactgtctcagttataatttttctttcttttttttttttttttttttttttttttttttgagacagagtctcgctcagtcgcccaggctgcaatgcagtggtgcgatcttggctcactgcaagctctgcctcccgggttcatgccattctcctgcctcagcctcccaagtagctgggactacagacaccccgccaccacgcctggctaattttttgtatttttagtagaaacagggtttgaccatgttagccaggatggtctcgatctcctgatctcgtgatccacctgcctcagcctcccaaagtgctgggattacaggcgtgagccactatgcctggctggttataatttttcaatagcagtttcataactttaaattcatgactattacagtattcataaataatctaggtaaataattaaaatagataattaggcaaatgtaatgggaaaaatacttgtagacaaactggtcataatttagaatataaagttatattaaattaaataatagatgtttcattacttgggtattttccaataaatatatattgcaggaaaacattcttgctaaaaaaaaaaaacaaaaacagagaagtgtgtccttttaaaaagaaaagtgaaaaatttatgtctaattcaaagcttatttaaacattatgtataaaacaaggtaaatggaaccaggaaataaaaaatatgtaaagaaagttgtaaaaataaagaggtatttttctgaggtaaaaaaagcttgaagaaaaataattttatataagaaaaaaagtcttgtgccaggcaccaaatacccggcatcataattgttatgttaaaattattgtgtgccacagaggcaacaaatttccttgtcaattgtgcctttcgactatggctgccttaaaactttttttttcagccgggctggtggcttacgcctgtaatccctgtactttgggaggctgagacaggcgatcacgaggtcaggagatcaagaccatcctgactaacacggtgaaaacctcatctctactaaaaatagaaaaaaattagcttggcatggtggcgggtgcctgtagtcccagctactcaggaggctgaggcaggagaatggggtgaacctgggaggcagagcttgcagtgagcagagatcacaccactgcactccagcctgggcgactcagggagcctccgtctcaaaaacaactttttttcatccatggacaattgttgtcttgttttggtcctctttaggaggtggttttataatcagctataaaactccaataggtgctcttgaatgcaggtttctgataactttggagattgtgacaacagaatagaggaagaaccttcaggactcatggagagctaaatgttcatgagtatcaagcaggaattaacaggaattaactgcatggactgaaccaatcttttttactttttgctcaaaatatttgctggtcctttgttttgcgtttccgagtcttatgacttttcttttgagctactgacagattttaacaatttagtatactcctatgaacaaaatttgtggcatagttgtttctatctgatttatccagaatttggaaactatttgtgagtattcttaacttatggcaatacagttatttgcataagtgcagtaagaatctgttttcatttgtaacaggacacatttggagaatttggttattttaccaaggctttgactggaatcatgtgctttccttataaggaatcaaacttgacttacggagccaataaagcccttggaaaaactggcctcatattctgtatacacagtccctgaacagggtttctgactgtgtaagtaaagaatatcactttttgacaagtgcagacgccccaggtttatcttgggccctcaaaaggagaggaaatttcacccaactcatgggtatttaatggcataaatccatggctcggctgggttttacgggttttacaaagtcttatctgagattcctgctatggaacaaagttccatcagagcctacttaaaagcctaagtaaaaaataatcattcttgctgcattgtatacaaatagttaggccaagtataataaacaaaccaatcctaccatgatttgtctttagtaatatgcgaaactgaagagagaaaaacaaattatcttctaaaacaattgtacacctgttgttagagtctagtcttgcctattttttttcaatttttattatttttctagagtttggactgaattctaatttttcttggctacaagccttcaaaataatgttttcaatttttttccttcttttttttttctcaatttttcccaatttggagtcactgaaaactaagctatgctttctaaaaaccctgggaactgaagccagacaacttaaacttcagaaaaatataacataacctatttacgtacataagccactttcatacctgcctactattatggactgcagagtaatgtggcctatatcaattttttcaggattgttcttttgtttgttgtttttttcatcccttcctcccccatattttctcttcacaggacatgagacttcacaacctgctaaaaatgaactttccagacctaccaatctaggaataaaccgtcctagccaggaaaggtcagatgacctttcctgagactggagactcattctgttgtaaaaatgctttctccaaagatgttaaaaaagaaaaggggaaaatgtgaaagaaaaatatcttgggtcccttcaagatgggaactgctcagggcaaatctgccttctattctattcaagtcatccatttgctcacagagacagatgcatattctgattgcctcctttggaaagacttatcagaaactcaaaagaatgcaaccatctgtctctcacctacctgttacttcgaagcccccaatagggggtcttgctttgagctgtctccgcctttccggacggaactaatgtacttcttacatagtgattgatgtctcatgtctccctaaaatgtataaaaccaagctgtggccggaccaccttgggcacatgtcatcaggacttcttgaggctatgtcactgggcatgtcttcaaccttggcaaaataaactttctaaattaattgagacctgtctcaaattttgggggttcacaggtgagtgggctcaggcatgtgcactagtatgactaaaggtcatagactattagactattagtctatgaccttcctctagaaacactcgactggtaagggaagaatgcctcaactgagcatgtgcacaactcccataaacacacttgtgcttgcggagcctctcaagtgctggcaggccactgctcaggtggattcttccctcctacccggagggaagaatcaggggagaagggacacaagcccctgaatgcatgccaacacgtaaaacctcaaatcaaaactcaaaccatgcagtttaacctctcaagttgcccacttggccctcttccaagtgtactttacttcctttcattcctgctctaatactgtttagtacattttcactcctgctctaaaacttgcctcagtctctcactgtgccttatgcccctcagctgaattctttcttctgagcaggcaggaattgaggttgctgcagacgtgtatgcatttgccaccagtaacatactttggtgccacatgactaggatatgttctctagtgctaacatgttcgtttacagttcttaggactccctgatagaaaaaaacacaaaaaaaaacacaaaaaaacccaaccaaccaaacaaacaaacaaaaaaaaaacacaggagtttctcccaaaaagaagtctgcagtgtcttttctgttttctctgaaggtatcccagggtgttagatttctgttgtttttcccttatgtggcaccgaagttggcaagaagaaggaagtgctgatataaataaatagggaaatgaacagagagagtacatgtggttagcaggagtttaggatgagagaaatttagtggaccgagaaatagtctaaatatcagttttaatttgtgaaagaaaaataaaaacctgggaccccaattcactatgcctaaaggaaaaaaattaagctaaaagctgaatcatgcaagaagctgttttttcctttgttcttaagcagagcactacagataaaaaggtgaaatatctccccaggtagctactctatgttcacctgaacttatgtaaagttctgatttactgagcatgagaagaacacataattgactattcctgtacctgctccatttctcctgcaacatgtggatacagtaatatgatcataccctcccttgttcccctctaggccactttcccctttaaatattaacaccatcataatcatctttggagaaagacacctggatctgtcctgaaccttggcaaaaaataaataaataaataaaaataaaaaactcttctcaattgattaatacctgtcacagatacattttggtttacaaatcaatgaacaatggagggaactctgtccttaatcttggtacgagacaatgaaccccaggtacttaccccagacaacgacgccgcttcaccatgatgatggacaacaggcaactttttttttggagtttcagcttgcttccaacagggacggtgagtgtgaggtttattcccatttctaagacgatagaagttttcagcctaagccgtattcctaggtaagcagctggattgcagttttgtcttggaaattctccttaatgactaaaagttaagattaacaactagctggtcttaatttctccttaccattagagtacccagtaatcacataaattctgcaatcatctgtttatttagcttaactgtttttttttatttgttgaagttgttgttgttatttcagtctttttcttattgggttgaccagacttggtaaaatctgtaagaaagttccataattatggggaagatttcctctgaattggctaaattcctgtagctgaaaaaaaaaagaaaagaaaaaaacaccagcaaaagtaaaaaaagaaacattttgattacctgagaggctttatttacatggcaagaccaccttctgctagccaaactaaactaaaggagcaatggtagtcaccctatgcagtagttcagcagcaaagattctgcccttttttttagcatgacagcctgggttggttggttatgaatcaagtcctttctggtttgagatttattttacctttgaaatatcagcagcttttcccagctaaaatatggtaataatatttaaaaggattttttaagacctcaacagttaaaaggcagcttaattaaaagatagtatccgcaatccgtgtgtgtgtgtgtgtgtgtgtgtgtgtgtgtgtatgtaaaaggactttatgtttttttgtcttctaggaacgtgtttttgtaaaaaagtttttttcttctcagtcaactgaattctgctttttctatttacttctgcctgtctctcctttctcttcccaccctctgctgcatgaggcactggaaataattttaacaatggtaatgagacaaattatcaagaaattggagctgggattccttaaagaaaacagagaagatgccagactccttctgggggcaaaacctctgtttttccttatggaaccctaagagtataaacaagttcctctcagatcttaaactccttgcttctatattttgttttctgattttttttaactgaaatagttattattacaggggctactcttgggagtttagaataagaaagggtgcttagacactcaagcaacatctttgtaacaaagtaacaccataaaagcattatgtggcctagtcccatgatttctctctcctttttggagacccaggattgaatgtgggctgtgctcagagctcagagatccagttaaaacagagactacgtttaaaactatctaagtgtgattggtctctttatacaatcctgtggtagatttctgtaattttatgtttgacttggtatccattttttaatcaccctgttaacacaacagattctctctctctctttcctttgagaagtaaattttgctgattttcacctgagagttgttccttcggtatacaaatttagggctatctacctgacaattgcctagggtaatgaaacaaattatcaagaaattggagccaggcaaggtggctcgtgcctgtaatcccagcccttttggaggccaaggctggcggatcacttaaggccaggaattcaagaccaccctggccaacatggcaaaaccctgtctctactaaaaatacaaaaattacctgagcgtggtggtgcttgcctgtaattccaactatttaggaggctgagacaggagaattgcttgaactcaggagatggaggttgcagtgagccaagatcacgccactgcactccagcctgggccacagagtgagactgcatctaaaaaaaaaaaaaattggaagtctaaaataagaggggaaaaaagaggaggtcttacaaatctaagatctatttctacctgtgtgtctaatacatgtctgtatttatgtgtcatgtatatgtttcattatcaaagatatataaaacagctctaattatttggccttaaagggaaaaaaggggcttaaatcaaatactttattagaaaaatagaaaccttaagcccaaatgctttttcaagtttatgtaacttaagtaaattcttaataaataagctggttttaaagttattggtaaaataaaattagaaatatcttcagaattgtcaatatacattgttgtttagagtcattggtcaggcagtttaacatttacctctactagatattataagttgtcaaaatttggcatgaggtttataaagctagaaatgcagcccacaagagtactatatttgttggtgtaatttgttgataaatagggcatttgatatcgttgatttaatgaaaacagctaaatcctgagttaatccaggacttcttggtaaagttgactgaagctatattagatatttccccacaaaaatactatttgcattctcccactccctccctcccttgatgggacaacatcctttatttttccttgggcatacatatcattacttccaatttgaaacaagttagtataagagggagagagagaggagaggagaggcagagagagaggagaggagagagagagagaggagagagagaaaggagaggagagagagagaaaagattgagagaggggagactgttttaagtggtattatttttcccataggctgtccttgtcactctttcatggctacagtttgatcggaattagctgccagggcctccgccggcttgggctcttctgcggaggctgtgggggcccgggccttgggtgtggaactaggggcttcctggctgcggggggtctccttggaagagggggcagcctccgagctgctgcggtttgcgtatcatgctggagcccgtcacttatggtctcctgggtggcaggagctgcaggcgccttagtctttttaggtttcccttcctccttgctgggctcctccccagtggtagggtccgcgctcttggcccgggccgtggtgacttcggcagctttgggggcctcgccgccattagcagggacgggggctgcctgctctttctcggggggtcagccttggcctctgcgcgctctctgtcttctcgggctcttccttcggggtctcctccttggcagccgtggcatccttcttgccctctgtctcctcggccttgccctccgcgtcctggtcagacttcttgccctccatggcctcggcgggctctgcagctgcctggggctcactctccttcggggaccctcctcttcccttgccacgccctcatccttcttgtctttgtccttggctttctcgtcgttcacattgtagcccttcttcttgctgagtttgcctgtcatcttggagtttggctctgggtgcctgtgcagcccctgggtgagcgcggtgcccccaagaggccagggtccctggcggtgtctagctcatgcctggccgctggcggaggctctctcctggctccatggcggaggccagagcgaggagccagttgtagtgctagctccgcctttgtcgcagctgccactactgccaccgggaaaacatttttcttaaaaaatgtgttcttatggccgggcgtggcggctcatgcctgttatctcagcactttgggaggccaaggcgggcggatcacgaggtcaggagaacaagaccatcctggctaacatggtgaaacctcgtctttactaaaaatacaaaaaatttgccagggtggtggcaggcgccagtagttcgacctactcaggaggctgaggcaggagaatggcgtgaacctgggaggccgagcttgcagtgagccgagattgcactactgcactccagcctgagcaacggagcaagactccatctcaaaaaaaaaaaaagtgttcttatttaaaggaaaattatttttgtgtaatttaaaggttattcatgaaacaggataaaaggaaccagtaaataggagagatgtaaagacagatacaaatataaagaggtattctggtgtaaggaagattaaaaagaaaattattttatatgagaaagaatcttgtatggtaaatttttgtcctaaaataaaatgactggttatttagaaaagaaggatgtttagaataaaacaggaagtccaaacatgtcataagtggtttgtgtatgtcataataagggattataaaaagaagatttatgtgaaaaaaattttatgtgatcaagttgtctacaattacaaggaaattatttataatagactttctagagatctatatgaaaaatacactaatacactaaggaattggttagaacaacaaaactttcttaacatattattttaataaaattatgagattttcattttttttacaccagaagttcaatttatattgcatcttgctgtttttagctatctcacctttgagaaggacagcaatgatatctctctctctctcaactttgtcagctcctgtaaatttttcgttcaggttttaactgctattgtggcctgatactaaaacattttatcttaaagttataaaggaaatattttctcccagtataacattctgtgctttggctttaaattgttctatgaaaccaaaaatgttcacttaatgtttcctgtaacccaggaaacactcttcctatgtctaactagttcaaatacattttcattagttttgactttcaggttctctaaatagactccctatatggaaaagcagtcacactgcagagggtgttttttttttttctttgtttgacttttagtaactagactaacaaaaaagatttatgttttatcgaaataagtcctacataattgttattaagttttgatttacttacaaaaactgagttacatttatttttaaagttaaagttactgtgtcaggaattggtgggttcttggtctcactgacttcaagaatgaggccgcggcccctcgcggtgagtgttacagttcttaaaggcggcatgtccagagtttgttctttctgacattcggatgtgttcaaagtttcttcctcctggtgggttcgtagtcttgctggatcacgagtgaagctgcagaccttcgcgggagtgaagctgcagaccttcgcggtgagtgttacagctcttaaggtggtgcgtctggagtcgtttgtttctgccagtgccttcatggtctcactggcttcagaagtgaagctgcagaccttcgtggtaagtgttacagctcataaaggcagtgaggacccaaagagtgagcaacagcaaaatttattgcaaagagcgaaagaacaccgcagtgtggaaggggactcaaagccagaagttcccactactggctcaggcagcctgcttttattctcttatatggccccacccacatcctactgactggtccattttagagagagccaattggtctgttttacagagagctgattggtccgttttgacagggtgctgatcggtgcgtttacaatccctgagctagacacaaaagttctccacctacccactagattagctagatacagagtgtggacacaaaggttctctaagtccccaccagagtagctagatacagagtgtcgattggtgcattcacaaaccctgagctagacacagtgtgctgattggtgtgtttacaaaccttgagctagatacagactgccaattggtgtatttacaatcccttagctagacataaaggttctccaagtctccgccagactcatgagcccagctggcttcacccagtggatcccgcaacagggccacaggtggagctgcctgccagttccgtgccatgcgcctgcactcctcagcccttgggtggtcaatgggactgggcgccctggagcagcgggcggggctcctcaggaaggctggggctgggcaggagcccacggctggggcgggagcaagctcaggcatggtgggctgcgggtccccagccctgccccacagggaggcagctaaggccctcggagaagttgagcacagcagctgctggtccaggtgataagcccctcactgccccggccagcggggccagcttgctgctccgagtgcgggccggcgcccacgcccacccggaactggcattggcccgcaattgctgcgcgcagccccgattcccgcccacacctctccctccacacctccccgcaagctgagggagccagctctggccttggccagcccagaaaggggctcccacagtgcagtggcgggctgaagggctcctcaagcatggccagagtgggcgtcaaggccgaggaggtgccgagagtgagcgagggctgtgagggctgccagcacgctgtcacctctcattattacatctatttaactttgtgttgcttttgaaatccttgtgctgttaagttacagggctttgactccattgattcctgggtctgaaaaagacaccaaaccctgctaacttttaaacattgacagcagttaaagcctcatcttcagacccaggagaagatgacagtcaaaacaaagtgtgtttataataagacacagggacagaaattaaaactcttcaactccccaatcccagggactactgcagaagaggtgagcacgtgagattgtaagggccaattttgagaaagaaaattagttcagggtttctctataaattaaacattagtatcaaaggtacactgatgcaagaccagcaactgggcccctgtgtcagattaatatggcttttgtggagcattaatccacttttttaaaaaatataaaaggttataaaaaggcttattgaattatatcttttagtcaagttgtttaaaatttagtagatttatttataagatttgagagacatttaattggtcttgacctaatgctatctttattagagcttactgtttgggaaattaagtctcctgtctcaaagtataaagggtttggccatttatttttacatctttgagttatcattttggctaaatgaatgacttatttattttacaatgacctgtgatcctatttcgtgatatcctgtgttttaaacttttcatatttgacaaactttctaaaatcaaatactaaattcagtccttttgacctcactaatgttttgatattaggtcccctgaagtccaaaacagacatatttggcttattttctacagaaaaaaattatacaggaagcattgttaaatatgaaatggtgtttaacctactttgggttatatttacataaatgtgttattagtgtgtgtcctaaaatcatagaatattcctgtgattctgatatgtctcaatatatgttgtcagtagtaattacgattattatgtgtaaaattgtcatatgccacaaaagtaaccaaatttccttgtcagttgtgtctctaactatggctgctctacaacttttgtcatctacaattgttgattactttgatcctttcatagtgtggtttataatcagctatagaactttgtggaattcacatttagagaccgtgtaattgaaatggagagaaaatcttccaggactctcatggagagctgatgttttcatgaggattcctgatccaatattgaccagaagttaactgcatggactgaactaacagacaattgaaataatcttttatgactctttgtttaaaacatttgctgattttgtttttcagagtcaagaaaccttttttatcttttaagctatttacagcttttaacatttgagtaaagtatatatatatatatatatatatatatatatatatatatatatttatattttaattgaggcagagtctcgcactgtcacctaggctggaatgcagtggcacaatctcagctcaatgcaacctctgccacccaggttcaagtgatcctctcacttcagcctcctgagtagctggggttacaggcacctgccaccatgcccagctaatttttgtatttttagtaaagatctggtttcaccatgttggccaggctggtctcgaaaacctgacctcaagtgatccgcccagcttggcctcccaaagtactgggattacaggtttgagccaccatggccagcctgagtaaagtgtactcttatgagcaaaatttaaaacaccttctcctgtgaaagaaaaataacaccttgggaccccaaattcattatgccaaagggaaagttaagcttgggaattgagtcatgcaaaaaactatcttccttttgttcccaaacagatagctgccatttcacatgcttactttattttatgtaacgtgcaggtttactgagcatgagaatagtgcttaagtaactttttcttatactaccttctttgcacatttaaaactgttgggagcaagccccccaaagtctggccataaactgaccccaaaactggccataaataaaatctctgcagcaatgtaacatgtccataatggccataacacccatgctggaaggttgtgggtttacgggaatgagggtaaggaacacctggcccacccaaggtggaaaactgcttaaaggcatttttaagccacaaacaaaagctgagcaatctgtgtcttaagggcttgttcctgctgcaattaatttggcccatcccttcttttcccttaaaggatacttttagttaatttaatatctatagaaataatgctaatgactggtttgctgttaataaatatgtgggtaaatctctgttcggggctctcagctctgaaggctgtgagacccctgatttcccacttcacacctctgtatttctgtgtgtatgtccttaattcctctagctccattgggttagagtctccccgagcgagctggtctcggcaagtggcgtccattcgtggaggctcgaatccaggtcaaagggttgctggagcgacggttggaatggaaaactagctggaagacacccaagtactcttaaagcaatccccgtggtgagtaagaaggggagctttctgttcccaaacagatagctgcaatttcacatgctttattttatgtaaaatgcagatgtactgagcatgagaatagtgcttaagtgactttttttctactaccttctttgcacatttaaaacatagactcactgaatgctaatcaaacgtcacaagaatgtaaccacttgcctcattgcctatcctgcctctttttcttcaccccacccccacctccccgcttgctctttcctatttaaatattgaagttcccaaaaccatacttggaaaatgcatggatcacagatcctacagtaacttgcatctgtttcctaagtgtgtcctcaaccttggcaaaataaacctctagtcaattgagatctgcctcagtcacttactggtttacattttggcaacaagggaattatctgactggagtttggccctgacctgcagcaactctcctatcagggccctggtacttgctgaagctctttatcactttgaccaattggacaattggctgaggtctggaggcttcttcctccagagattgctgatctcacaaaagtttgtggttgagatctgaggtttactctgctgaagagctccttttcttagagtttactgcttctatgatgaagagcaatcttcagcttggtccccatctccaataacaaactcatttggagtttcattttgagatttggtagctgaagatcaaggtttactatcagctggctctgacctcttcttatgctcagagatcttgactgtatttaaactgtgtgatcactttctcagctttttggggttttttttactacctaagaggtttcatttacataaaaaggctgctttcccagcctctctctctgtgctattaatttaaaattttagagagatcttattctaagtaagtaatgaaaagaacagattttgaaaaggacacatagcagtgtcgcagcaagccttaaaaattctcttgataaaactaagagcaaactgtatggcctaaaacagatctggtagttaaaattctgtgacagtgttttccacctaaaatgtgctacagaggttgtgtctatgatactatttggtttcattgcaagagtaccaaaagtaaactgggtagaatccaaaggaaattgtatacaaatctaacagtcagtttatagcatttttgttgccaaattataagtaaattgtaggtatttattaatatcattccaaggaatgactagcagtgcaaaaaataggtactttagtggtaacaattatttgctaataatccagaacctacaaataacagaaggaaacagcacactcttaaataaataatgggacaaggaagaaactacaaagtcaattagaaaatactttaagattatgtagaatgagggcccaacaaacgaaaatgtattgaatgcagtgaaatggtgcataaagggaaatttattatttaaatgtttgtatctaaaaaagaagtaagggctcatataaataaacccaatcttccacatacaattctggaaaaagaagagcaactaaacctaaagtgagcagaaggaaagaactaataaaatgttaagtgaaaaataaaggagagaatacaaaaacaataggtagaataaacaaatctaaaagttggtaccttgaaaacatcaacaaaattaacaaacttttcacaaggatgagcaagagaaaaagagagaaggctcaaattattaaaatcaggagtgaaagggggaacattactacagaccttatggaaataaaaagaatactgagggaatactacaaaaaactgtatgccaataagttagacaacatagacaacattgacaaattcctagaaagacataaactactaaagattactcaagaaaaaaatagaatatctgaatagacctgtaataaataaataggttaaattagtaattttcaaattttccacacacaaaaaagctcagccctgggtggctttaatgcttaataaaaccaaaaatttaaagaagaattagtaccaattcttctcaaaaggtagagaggaggagcagacacttcccaactctttctgtgaggctagtattatcctgataccaaaaccaaacaaagatagcacaaaaaagaaaactacagaacaatatattttaggaatatatgtgcaaaaatcctcaaaaagtacttgtagaccaaatccagcaacaaataaaaaggttatattccattccaagtggagtttgttccaagaatgcaagattggtttggcatctgaaaaccaattaatataatatatcagattaacagaataaaggacaaaaccatgtgaccatttgaatagatgtagaaaaatgaattgacaaagtccagcacccattaaggataggggaaaaaacaactcaacaaactaggaatagaagagaactttctcaacatgataaagaacatctacaaaaaatgatctgaatagacatttctttgaagaaggtatacaaatgacaaataagtataataacagatgctcaacattattagctgtcaattaaatctgaatcaaaattacaatgatatatcacttcacaactgctggtatggctataataaaaaaacaaagggatactatatggtccattagttttacttccaggtgtctacacaagagaaataaaaacgtatgtccacataaaaacttgtacacaagttttcattgtacactattttaataacatccaaaaagtgcaaacaatctaaatgttgatcaactgataaacaggcaaataaaacgtgggatattcataaaatgtagtattcgggtaaaaaaatgaagtactaatacatgctacaatatggatgaaccttaaaaatatgatgccaagtgaaagaaaccaaataataaaagttcaatattgtatgatttcactcatatgaaatgtccagaacaggaatatctatacagacataaagtagattactggttacttatggctagagatgatgagagaacaggggagtgactgtaagtgggtacagggcttctttggggaatgatgaaaatgttctaaaattaattgtggggatagtcatacaactctgtgaatggactaaaaacattgtatttatatacactttaaattactgaagtgtacagaatgtaaattatatctcaataaagctgatatgtgcatacacacacacacacacacacccaacagcagaagaaaatacctaaaaggtaatgaacaaaagcattcagattaaagcatgagaatctgaaggtttggtcatctacatcttgttccatagataagcatagactgtctactaaacacagttgtcaacttgatccaaaaatcttcgctggattctgtttctttcaagactgtttctagaggggtccacaaataattatctttgaagtttctgattaggacatctttccagggattctaagattatttatgcctctttaattaaaagactttaaggatcaatatattggagttgccctcttgtgtccattattagcagtatttgatatcaactttttcattcgtgttctagagctttttctcttatttctttaagtcagaacaccagatcttcaggtttacgatcatgcaagtttttaggaagattatgagaaaaggttgcctgtgcctgtggatcataaggttgaatgtgttgcattaattccttgcaatatttcgcagtatccatttgcaatatgttagagtctacaatcagaggtgacatttgtagatatttgtgtaggccagtctgttactaatgtataagggaagagtttatgaacctcaaagaaattgatggcattgacattaaagccatggcaatacctcgggctatggaattttgaaggtttctgagagctttcctgattttagtttctgaatcttctttttttttttttttaatctttcttgaatagtgaagctgatatgggcagtgaagtttctgagtaagtgttaaggttttgtaaaggtttttaatgacagtgccagtacaatggtttttttctgtcacttgaaaaatgggttagaattttgtaggttgggaacacaaaatcaagtaatatttttgctgccattggaactgaaagtattcagaaaggaaatgcttcaattcaatccccaaaataaatgaacaatgagaagaacacgtttaaaatctactgagtgtgtagtgatcatctgtagttgttcaaacgctctctgaagcttatgctcttgttcatgtcccatttttgagttgtgcctacatgatgctggcaacagataagacatgtagttttaataaatcactaacctttatattctgcttatttttaaattataaattccatctgtgtaaatagtttctctcttcttgcactttactaaaagcagttaaaagaaaccattctgaggctgggcacggtggctcatgcctgtaatcccagcactttgggaggctgaggtgggcggatcacctgagatcaggagttggagaccagcctggccaacatgctgaaaccccatctctactaaaaatacaaaaattagctggacgtggtggcgtgtacctttaatcccagctacttgagaggctgaggcaggagaattgcttgaagctaggaggtggaggttgcagtgagccaagatcacgccactgcactccagcctgggtgatagaatgagacttgtctcaaaaaaaaaaaaaaaaaaagaaaagaaaagaaaaaaagagaggaaaaaaaagaaaagaagccattctaagttcttactgcttagagatttcttcattcgtaagttcattgctcttaagttccaccttccataaagtcctaggatatggacataattcagccaagttctttgacactttataacaagaatgacctttcttccagtctccaataccttgttcctcatgtccatctgagacctcattagaagaaacttcactgtcatgaccacttaaataatctctgagaagattcaggatttccctacagcttttgtcttccgagccctcaccaaaattgcccttagtgctcagttcatggcaatttaggttttttctagcattaacttcaatactgtgccatcctctctccccattacctggttccaaatccacgtccacgtttttaggtatttttcataacaacaccttacttctctggtaccaatttttgtcttagaacatttgtgctgctataatagaatatctagctattttaataacagagactggataatttataaagaagataaattaattctcttacagttctggaggctgggaagtccaaggtcaagatgctgacaaatgatgagagctttcttgctgcatcctcacatggaagaaggtggaagggcaagagagaagaaactaatgctaggaaatgcctcttttaaaagggacttagtcccattaacaaagaagcaggtcttatggcctaatcatctcataaaagcaccacctcttaatactatcacattggcaataccttgattttggaggggacacattcaaaccatagcagagaccactaagtatagggaagactaaacccgagaaccaagtggccagaagcctgcactagctcagctgattctgctattagacttagataaagtatgagccttttgctactgaatcaacagaaaggctgcccgaaagcagtgagtctcagatgcctcccatgaagttcacacatcacaccagggacttctactcatacgtgaaaagctagagaatcatgtttaggtaggcaaggggagagaggtcctggacaggttattgaaggactgattttaaattacaaaatacctctttatgtttagtttgcaaacaaaaggagtcaattagtgaaggcttggctgagctgatttcagaaacagtagggacccactttttgcagtagttaggaagcctcaggatctttttaaatgtatcctaattactagcctaggaaagtcttaaaagagctatagtttgttgggagaaagggatttgccttctttagaaaaatctatctttggtaatgcacttggttttgacaaaaccaagtgcattggttttgttactttcctttaaaaattctatctttttaaaacattcctggaactcatctgttctttttttttttttttttttttttgagatgaagttttgctcttgttgcccaggatggagtgcaatggtgcaatctcagctcactgcaacctccgcctcctgggttcaagtgattctcctgcctcatccttcctagtagctgggattacaggtgcccaccaccacacccagctaatttttgtatttttagtagagatggggtttcaccatgttggccaggctggtctcaaactcctgaccttaggtgatccaccttcgtctgcctcccaaagtgctgggattacaggcgtgagccactacacccggcctcacctgctctttaggatatggcagcagatcatctatatatcagataacaatagaaccacagaaaaatttaagatccttaaaattcttggttaaggattattataaaatagaatggtatttcagtaaatccctgaggcttaggagtccaggtacaatgttggttctcaattaaaatataaatcatgtctagggacacttaggaacacagaacatatatttagagctagaaaatatacagcttcagaccaggcatggtggctcatcccagcactttgggaggctgaggcaggtggatcatctgaggtgaggagtttgagaccctgtctctactaaaaatacaaaaaatttgctgggtgtggtggcacatgcctataatcccagctactcgggaggctgaggcaggagaattgcttgaacccaggaggtggaggctgcagtgagctgagattgtgccactgcactccagcctcagcaactctgtctcaaaaaaaaaaaaaatacagcctcaaataggactaaaaataagattatatataaatttggttttccaagtgtatgaggaataactatgaggctgaggtcatgaacaaatgtatattctcgcattgtttttttttttttttttgagatggagtctcactcggtcgcctgggctggagtgcagtggcgcgatctcggctcactgcaacctctgcctcctgggttcaaggaattctcctgcctcagcctcctgagtagctgggactacaggcacacgccatcacacctgggtaatttttgcatttttagtagagacagggttttatcgtgttagccaggatggtcttgatctcatgacctcgtgatccacctgcctcggcctcccaaagtgctgggattacaggcgtgagccaccacgctcgtcctcacatggggttttattattaggatggtaagagtattataaggattggtacaaggcatgatgagtccttttgcttttaggcttttgacttctggttttagactttctttagcttctgttgttagacaacattgtgcaagcttggtttttataagtttgcatggattaaactgaacttaatgaaattgtccctccccccaaattctcagcacaatttttaggcccacaaggagtcaagcacctcaaggagatcttcagtttgaacttggtgtagacacagggatactgatgaatcaatattcaaattagctgttacctacttaagaaagagaggagaccttggggatttcgaggaagggttcgtaagggagattttagctgagaaataccatttgcacagtcaatcacttctgaccaagttatcagaaaaaggagaaaagaatgtctccccactaaatgttctagggtggtgagaaatctagggtggttatctaaatcaacaatatttagatattccaatatctaaatattgttggaaatactctcctgaagtgttcattgaactctaagagagacagcttgtgtatcagtggcagggtttaaggttcattttttattcccatattaatcctttaatatttagacaaatttccttctgagtttaaggataaaatgggatgggttctgcctgggcctggccctcatggggacatcaaagggcaatgttgcaaaaaaaaaaaaaaaaaaaaaaaaaaaatcagaccatcagattgcatggggggaaccacccccataattaaattacctccacccagtcccacccttgacacctggagattatggggattgcaattcaaggtgagatttgggtggagacatagagccaaagtatattattcaaataagaaatcaaaagagaaattggaaagttcattgagctgaaaatgaaaacacgatatatcagaatcagggagttgcagctaatgtatgcttggaggcaaatttaagcactaagatcctatattataacaaaaaagaaaggtctcaaatcagtgacctgagttttcaccttcagaaactggaaagagaagagcaaattaaacacaatgtaagcagataaagaaaataataaaaaaaacagaaatcaatgaaagaaaaaagggaaaattataagaaaaatccaagaaagtaaatgctaatcattttaaacaatcaattaaattgttagacttctagtcagctgatcaagaaaaaagtaaaaaggcacgaattaccaataccaggaatgaaagggtgggtgtcaccaaatcttctacagtaattataaggaaacaatggactactgtaagccatttttttctaataaatttgataacttagatgaaatgaacacattccttggagggcataaactatcaaagttcactcaagaagaaatagataacaagagtatctattgacaaaatcaagtttttaattaaaatcctaatgacaaagaaaactaaaggcccaggtggttttcatggtgaagtctaacaatatttaaggaaacaataacaattctacgcaaatccttccagacaatagaaaaggaaaaggtctttcctttatttgatgaagatagcattactttcttactaaatcaaacagacatcataagaaacaacaacagagaccaataaccctcatgaacaatgatgaaaatattcttactaaaattttagcaaatctagttcatctatatcatgacaaagtgtactttattgcaggaagataaagttgatttaacattcaaaaatcaataaatgaactttaccatattagtggactaaaaagaaaaatgcatatgatcatcttaatagaaaaagcacttagtaaaacccaacattgagtcatgattaaaagccctcacaaaaccagggataaaatgaagagtcctcataggatgcaggccatctacacaaaaatctatgtcttcctaaaattgagaacaaggtaaagatatctactctcatcacttttattaaacattgtactggaggttctaactcatgaaataaggcaagaaaaagaaataaatcatctagattggaaagagtaacactttccttatcatttgtgtacaccagtccatggaatccatgaaataaaagctattagaactaataagtgagttagcaaggtggcagagttcaagattaatatacacaaatcaagggtatttttatataaaacaatcagaaattgaaattttaaaaatgttatttccaataccattaacaaatataaaattgttagccataaaccaaataaaacatgtggaagacttgtacattgaaaactgcaaaacattgctgagagaaattaaagaagacctaactaaatggaacatgtaccatgttcatggacaggaagacttgaagttgttaagatgtcaattctcccaagttgagttatagatcaattgaatatcaatcaaaattccagaaggcttttaaaagtgaaaatcaataattgaactttaagttttatatggaaaaaatgaaggacctagaatagtgaaaataactttgcaaaagaagaataaagttggaggacttacttatctgatttcaaggctaaatataaagctatattaaaacagtatggtattgccatacatatagacaaatagatcaatgaaacacaatagagattccagaaatagactcacatatatatggccaatagattcttgacaaagtacaaagacaattcaatggagaaagtattgtcttttcaacaaatgatgctgaatccccaaaaaagtgaactttgattcgtacctcacagcatatacaaactttaattcaaaggaattcatagaccttaaactataacatttttagaagaaaatagagcagaaatctttgtgaccttggatacaacataaaaagcataattcataagagaacaaattgataatatgcatttcatcaaaattaaaaacttccactcttcaaaatacactgttaagagaatgaaaagacatagatcaagaggacgtatttttaaatcacgtatctgtaaaggacttctatgcagaacatataaaacccttgaacctcaataataaaatgcaaacatgcaataaaaagaggaacgaaagatttgaacagacacttcaccaacagaaatattgatggcaaacaagatcaggaaaagatgcttaatatcattattcaataaagagatgcaaattgaaactacaagttgataccactacacacctgctagaaggtgtaaaattaaacagactgatataccaagtgatggcaaggatgtagagaaattagaaacctcctacactgctcatgggaaggtaaaaatggcacaaccactttggaaaacagtttggcagtttattaaatagctaaatacacctaccatatgatccagccattccactcctagagagagaaaagcatatgtctatataaaggtttgtatgcaaatgtttataacagctttatttgtaataaccaaaagctggaaccaatccaaatgttcatcaactcctgaatgcattaacaaattgcgtttactgataaaattgaagactcttcagccatagaaagaaatgggttgttgatactgccaaaaacatggatgaatcttaaaataacttcgctgaagcaaagaagccagagctcacaaaagtatgaggacatacactatgcttccaggtatataaaattatagaaaatgcaaactaacctatgataactgaaagtatgtcagtggttgcctggggacaggctgagggtggagaagtggagggaaggattacaaagggcacaaggagagactagggtgatgaatatgtttattatctttttttttttttttccccgagacggagtcttgctctgtcacgtaggctagagtgcagtggcgcaatctcggctcactgcaacctttgcctcccgggttcaagcgattctcctgcctcagcctcccgagtagctgggattacaggcgtgtgccaccacgcctggctaatttttgtatttttagtaaaggcggggtttcaccatgttggccaggctggtctccaactcctgacctcatgatccacccgccttcacctcccaaagtgctgggattacaggcgtgagccactgagcctggccgatctgtttattatcttaactgtagtgatggtttcacaagcataaacacacatcaaattttgcactttcaatatgcgcggtttagtgtatgtcaatcatccctcaataacactgttaaaaaaagaaacattaaaattaaattgtaaattatcaaagaaaaaaacactaaaagcacttttaaaaaggcataactgtaaagggactctgattagattgagagcaaacttcacaactgcagcaatcacgaccacacacagtggaacagtatattccaagtgctgatgaaaataatcatcaaaatggaatctaccctgctgaacagtgttcaagagatagtataaaatgaatgctttttaaaattatttatttttagggcggggctgccaagggaggaggaagatggcggcgggggcgaggtgaggtgttggcagtggaaaggggttcgggcttagggggcggggggacgcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcgtctgcaggaaccgccatcaccacccgcacccgcgccgggggtcgtgcctgcccgcagcccaccaccaggtgcgctggcgcgcggacggcccttccctggagaagctgcctgtgcacatgggcctggtgatcaccgaggtggagcaggaacccagcttctcggacatcgagagcctcgtggtgtggtgtatggccgtgggcatctcctacattagcgtctacgaccaccaaggtattttcaaaagaaataattccagattgatggatggaattttaaaacaacagcaagaacttctgggcctagattgttcaaaatgctcaccagagtttgcaaatagtaatgacaaagatgatcaagttttaaattgccatttggcagtgaaggtgctattgccggaagatggaaaagcagatattgtgagagccgctcaggacttttgccagtgagtagcccagaagcaaaggagacccacagatgtggatgtagatatgttagtttactcagttcaaatggttgtcctgatcctgatttagtactgaagttcggtcctgtggacagcacacgaggctttcttctctggcacatcagattgactgagattgtctctttgccttcccatgtaaacatcagttatggggactttttctctgcccttcgtcattatgcagcctgtgaacagcgtctgggaaagtggtggtcattggttgcataatttgatctgaggcttatggaggaaaggacccaagtgactctgatgtttagaaagcacctatgaaaccctgtacacacctagttcataatcctcataatttatcaacaaacacaaagaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctacttccctgttttcgtggggagaagggggcctgattagaactgttctggttgtgtttggcgggaggggaataaattttgttcagtccttcttagtgaccaaactttaatttttaggaataacatattgacttactgaactgaagcattctgagttgaaaggagccccagaggaaaggagttctgtgttgctcacatgttaaaagcttgctcaccttcagagcagagggaatacctatcttcagatatccgcccattttcatctcttcattatagtcaaacagtgtgacttgagagtgttgctctggtgtctgtattctggcttatgaagattatttgaaaaagaactcttactacattgaaatgcagacttttaaaaatttaaatattggattaggcagtcaaaaaaccaaacaagcataaaaggtcagtaagttgtaatcttaaaagtaaaggtggaaaactcattataaatggaagaaaagttttgatttccttttttgtttgatgggcagtatgccatattatatccaaagttggtttaaaaaatacttccatcaactatttttatttaaaataaacatttgagggaagttaccaaggcagcttttttcctcaaaagtaacctgttcctctttggaacagcacattttaggggcatggttaatacctgagatttttactcagtaaacctgatggttaccgtgtgtaaaatatctttaagtaggattgaaggcctctgtggggaatataatgttaccaaagcctataaaaataaattttacatgttcttttttatgacagagagcagcactggttctgttattttttaaaatgaataactgatttcttgacaggtgtttagtatttcttccctcactgctgattcttggatagaaaccattctttgtatttgatagactgttttcagaaaactcttatcaacaagtgtacaatagttatctaaaactgtacatttagaatggagcagtttaatactagatctcagaaatttgaaaaatagcaaagaagagtggatttggaaagcatggtctacaattgcttgtcaattctgaagctatgaagaataaatgtttcagctttggattatgaaaccccgtttatgatttttaaaacacacttgaaataaaaatgattgaactaaattttggtccggtgacatcattttgcactgcatagcccattatacattgtaagtctttttgttttaatttattactgagagttttctgtgaagctacagcatatctaatcagagaatttctgatttgtttccttatactgtgattatgttatattaaggcatttgtagtgcagcttaagactgaatttatgctttttgtaaacatgatcggtgtaaatgtcttataaacattctggagtatgtataactttaatgaatgaaatttaatggacctgattaaaataaagggatttaatctttgttaaagtgaagttagtggaataaattacctactggaatatagtccaagtcactaaaggtttaatatttgcatttttgtgcttttattttctccttccattcataattatatacttgaaagtacatctgtagcctatgacttgagtctcttgaacttctaggaagaggcaaactacaaactactaggattctgatttcagatataggcattccagaatcttctctttacgagttcacctgctagtataatctccacaacttgaatggccttggttgttctgtaattgctgccaaaatcatcacaagctgtacgtcatcaaggctccctttgcactcccaagaagaactgttcattttaaacaaaagtgtatgtctttatttgtattggaaaatattgtctttaaattgtttcttgttgacacttcccacaatggaaaaattaccaaattaaacctgttttatggatggcagcttggagcatagcaagaagttggaggatttgaattccattcccagttctcattgcgttttgtttcttaaaactataataattggttactgttataaagtttaaaaggtggttttaatatgaatagcaaattctggtatattgtgactaacgcttaagaatgcctgtctttgagaggaaggtgttataatattaatcaacagtgccaaatacactgtgcatatctacaatttaatctttgaatgtttgttactggattagctccctcctccttctgtgtgatggtaccatgcatagagtcaatcaaatccttgtgatgttttgtatggactttgacaacatgtaactaatgtgtaaagcaagtttttatgattaaggaatcaaatttattgaattttattattgaaagttgaaacttaacatgtataaacaaaaaacaataaaataataaactattttcattgactataaaaattatttatttttaaaaattcatacataatactgtatgtatttgtggggtacgtattggtgtttctatacatacaatgtatagtaatcagatcagggatattagcatatctgccatctgaaatattgatcattttttgtgttgggagaattcaatgtcctcttttagctatttgaaaatatatattcttgactacagtcatcctacagtgctataaaacattagaacttattccacctaactgtaattttttgtcctttaacaaatctctccctatatcccccttccctttccacccttgaataacctggattctactctttacttctatgagatcaactattttagcttctatatatgagtgagaacatgtttaacttcctgttcctggctcatttcacttaacaccatttcctccaggctcatccatgtttccatggaggacaagaattcattctttttattgctgaatagtattccactgtgtgtgtgtgtgtgtgtgtgtgtgtgtgtgtaggtgtgtgtatgtgtgtgtataaaatcatattttctttagccattcatctgttgatggagacttgggttgactccatagcttggctattgtgaatagtgctgcaatggacatggagtatggacaactcttggatgtactgattttctttgctttggttctttacccagtagtagggctgctagatcatatgctagttctatttttgtttttttgaggaaactctatactattctctacagtggctgtagtagtttacattcccaccaatagtgtgtaagaattcccttttctccacctcctcaccagcatttgttttttggttttttttttgtatttttgacaatggccattctaactgaagtgagatgatacctcactgtggttttgatttgcatttatctgatgattagtgatactgaactttttccatatatttgttagtcatttgcatgtccttctgagaactatctgtttgaatcatttgcccatttttaatttttttttttttttgctgttgagatgtttgaattccttgtgtattctagatacaaatcccttgttggatgaatagtttgcaggtatctctcgccctatgcagaagttaactcaaaatggatcaaagacttaaatgtaaaacctgaaactataaaaactactagaagaaaacacagggaaaatgctttatgatattggtcttggaaaagattttatgaataagacctcaaagcacaggcaacaaaagcaaaaataaacaaatgggattacataaaagtaaaacgcttcagcataccaaaggaaacaatcaatgtagtgaaaagagaactaacagaatggatgaaatgaagactttcagaaccaaaacatcctgagagagtgtcccactgaagacctacacacaataccctactaagaggtattctttgaccaaaagtaaattgaacctgggaagatggaataagatacatgaagctcgggtgagcaaagaaaatgcaagataatacaggtaaatctaaaggagcactgagtgtgtaaaataataataatcgtaactaataatgcaggtaaaaaaatactactgaactaaaaccttatagaagataaacactaacttatgatttaaggagaacaacaacctcttaacctaagaatacaagagaatttccttatcctgataaagaggattaaatcatatagaaagtattatctttcattgtaaaattcagtgctgctctaaaatcagctccatttttatgtttcattgtgctagagaccctagaagcagattgtgagataaaaagaaatctgttattgggtctaggaaggaaaaaaactaagctattactatgtgcagaacatttttgaagaggaaattaaagataatctagagacagctgttagaattaactagggagttcaatgaattgcaggatataaattcagcataaaaattactagcaaaaattagataagtatataagattccattaacagtgaagaaccccacaaggttcctagagatacatgtaataataatgtgcaagacgtttctaataggaggaaatgggtaaactttgttggaaggcatgaaagaagacctaagtgaatggagaaatatgccatattcatgaatagagagactcgttaatgatggaaactatcattacattgatctaaagataaaatgtatttccaaaatcttttcccaaaatgtgtttttcatgctgatttacaaaattaacatacaagagcaatgagccaaaaatagccaagacatacctaaatataaaggcgagagagataacagatatcacaacttattttatagagctacaagtcttaagagagtgtgatatggttcagagatgggtaaataaaataatgaaactgaggctacagctagaaaaagaaccatgaatacatgtgaacttggtatatgatgggggcattacccttcaatggggaaggggtgcactacttggcacgtggtgctggagcaacagaaaacaaattcatcaagaaaaaataaatcacaggtaggtcagcacctacacgtgagaatgcaaagctataaaagataacatgagtttataccaatatcacaaaacaggaggaacagtttgaggtatcagacacattaaaatttaaaattctgttcagaaaaaggcaccatcaataaagcaaaaaaatgtacaagcctcagtctgagaggatatatttgcaatccacataaccgatgaagtatcactatccagatacataaatagttctgaaaatcagtaagaaaaaggcaagtgacccaatggaaaaatgagcgaatgataagaaacaataaatatcaagagaaaacaatgggcaataaatagtgaaaagaggctgaacttcactgctaacactgagaaacacaaattaaaacaactagatgccatttttcacccattagagtgtaaaaaattaagaagtttgatactacagagtgttgccatgaatctgtggaaatggaaactctgctgctggaaggcgtataaactggtataaccactttggacagcaatgcagcaatacctaataataatggtaatgatagcgctaatgtttaatacttattgaacatttataaagtgccaggcattgttaaaagctggcatggaaagctgatgacacacattcccagaagccaggggctcttcctacagtggcctggcccaaggacccctgcacatggcaccagcagacacaagcaaggctgctcatggtgtggtgggaaagcagaactcgtttgtaagttcctgagtggggaaggatcactaatctgtgcctcattggcacaacagaatattctactccagctaacagaaacacactgaattgatgtccgtcaatatggataaatttcaaaaacttgattttgagtgaaaaaaagcaagttgcaagaatctttacaccatttggccatttatgtcaactttaaggcacataaaatattgttggaggatgcaagcatgtgatagaaaagtacgaacttgtaggtgggaaatatggacaccagccctcctccatagagagctgacagctagctggggagctagcattggtccttctgtccatccatccacaggagccaggccatctccaaggagggaacaccggctaagggaagcaagagccagccttgaggagctggaacctggaggaaggttattctaggaattcaaggacttaagacatttgaaatctactaacctcatttgttatgattcattatacattaaaaagtcaggaaacagcagatgctggagaggatgtggagaagtaggaatgcttttacactgctagtgggagtctaaattagttcaaccattgtggaagacagtgtggcgtttcccaaggatctagaaccagaaatatcatttgacccagcactcccattactgggtatatacccaaaggactctaaatcattctaccataaagacacatgcacacgtatgtttattgtggcactgttcacaatagcaaagccttggaactaacccaaatgcccattaatgatagactggataaagaaaatgtggcacatatacatcatggaatactatgcagccataaaaaaggatgagttcgaccgggcgcggtggctcacgcctgtaatcccagcactttgggaggcggaggctggtggatcatgaggtcaggagatccagaccatcctggctaacatggtgaaactccatctctactaaaaatacaaaaaattagccaggcatgatggcgggtgcctgtagtcccagctacttgggaggctgagacaggagaacggcatgaacgcaggaggcagagcttgcagtgaaccgagatcatgccactgcactccagcctgggcgacagagcgagactccatctcaaaaaaaataaataaataaaataaaaggatgagttcatgtcctttgcagggacatggatgaagctggaaactatcattcttagcaaactaacacaagaacagaaaaccaaacaccacatgttctcactcggaagtgggagctgaacagtgagaatacgtggacacagggaggggaacatcacatactggggcctgtcggggtggaggggaaggggagggatagcattaggagaaatacctaatgtagatgacgggttgatgggtgcagcaaaccaccatggcacgtgtatacctatgtaacaaacctgtacattttgcacatgtatcccagaacttaaagtataataaaaaaaatttttttaattaaaaaaaaaacatgggctcaattaacatgcagccaaggtaacacttgttaaaaatcctacctccatgcaggatgagaattcctctggaggtgggaacagagaaaacttcatgcttggtaaagcacctgaggcacccattacaatctgggacaagatgaggacatcaacactcatgctgtattccacatgggaggccaagtcaactcaagatgatttttaagagatataagagccaggcatggtagctgatacctgtaatcccagcactttgggaggctgaggtgggaggcttacttgagtccaggagatcaagaccagcctaggcaacaaagcaagaccaagacgccttctctacaaaaaaataagaaaattagcctggcatggcagtgcacacctgtggttccagctacactagaagctgaagggggaggttcacttgagccccgagtttgaggctgcagtgagccacattagtgccaccgcactatagcctgggtgacagagcaaaagcctgtctccaaaaaaataaataaataaataaaagctataaatactgcaaagaggcaaaacctgctgttgtttgctgacaagctaatcatatctagcaaatccaagaaaaaaaaaacagtaaaaaatgaataagagaattcagtaatatagtcagagatgaggccaacatataaaaatccatgtctttctatatacacaagaaataaccatttgaaagaagctgtcctatttacaatagctagaaaaactgtgaaatatctgggggcagaggttggaagaaacaaaaatgcacacaaaacttgtgagaggaaaaccaaacctttattggcaggcacaaaataaactttctgagtaaatggaaaaacattctcttcttgaatgaggaaattaacattgtaaagatgtcaacggtctcccaaagtgatcgagatgcgccctgtgcagtggaatcccaaactgtaattgcatctttcacggaatttgacacactgactgaaattcacctggaaaagaacatgcttagtaaacatggtttcctgagggggaaaaaaaaaagaaaattggttttgcagacaaggttcaagttagagatcccagaaagaaacggatgtatctccatgcggtgaggtacgctgggaagggcatgtcccgcggaaagagcagggtggacgatggaccgtctggaaaacaggctgccaggggacagaatcaacacagatttccaagtcacaaaaacacgtaaattctgtggattaaagaaagatatctagagatctacaaacacaaatctaaagaatccttgatttcactgaaaatcaaagatgttgatgagggtaatcatgagctattgtttttcactcataaaattgggggtgaaagacaaggattaacctttctagcgatgataaaggtgtaaaaagtatttggctgcgcggctggtggtgaataatttttacaaccttctcagaaaacaatatggaaacgtccagcacaagccagcagagaaagcctgtttgaggcctctgctgtggatagggacgcctgcctgaacacaggggaatcatgcgcatccatgctagctgcagtcattttggtaatagaaaaaaaaaaaaaaaagaattagaaggggaaggaaagagaagcaccttaactcttcgccggcagagatcttgttacacagcagcatcgccccacagggcagaggcctctgcagccatcaaagaaaatgagatcgagctaagtgggccaacgtggaaagctcccgggacatggtgttatatgtaaaaagcaagttgcagacgacgcatgaaatatgtatgattccatttgtgaaaaagcagcatcgctagaaaaaaactgtatattttatttcgtatgtacacacagtgtgtagatccatgtaaagaaagcagtccagacggtggggcggggttggagatgcagccagccctgctttgtgtctagatactccggcatgcttggcgcccccatgcccgaggtcatgtgctcctgccataatttaaacaaatgcctgaacagcaaaatgaaattagaataggcagctagacgtggtctggagcgcaagaggaaggtgcggtgcggtgaggtgagaagagagaccgcgctagaccaggcgatgtcttagggacgggagaggggtgaggcccacggcggtcctggggagcggcccacgaccggcccacgcagagcttgtagccagtgaacaggaagtattggcgagagggactgagaaacccaagagagtgtggggtgaggaaaaggtcaaggaaggcccaggcttccaggaagggcctgggccggggcggggcgggtggtgggaggcagtggttaggacgggcgggggtgggggtgggggtgggggtaggggtgggggtgccacaggaggccggcgtggccttggaagccgctcagccgcgcgggggagcccggggatccgaggagctgcggagggaaggggaggagcagggcgtggttggaaaggcggtgggacagggagggctgggctgtgcggctgtcccgtcctcgtgaagaggagcgttgggaggagccgggagagacaaggctatgggcggcgggcggggacggctgtccctccctcaaggagtggagttagcgaggctgcgctggggtgctccgttgccgaggatgggccgagttcgaggcggcaaaggtgcgggtgtgcaggggggaggcggcgccctcctcgctgggtctggggtcccgcagcgcctcgggccggagcagtgagcgagcgtgggtgggagctgcggcctgggtccttgagcccggctgccccgacggcaggtgcaccggggttgcgggggactcggcgcatctccagggcgagtgagtccagggccttcggcctacaggctgagcaacgcggacaacagcgagggggctccgtggcacagctggcggggtcacggcgcacgcctgggcgccctggagcccggagactcagcagccatcgctcggggctaccacggccctccaggctcctgagccacccgcacggaggacgagctgcggagcgcggtgtgcggatagccaagctcctgccgccaaggccaccccgagcccaggctgccagggcggcatccacagccggcggcccgcgggcctgggcctgagacccgcgcagcagccccgcctgccctgccgtgagagggaagtagaccgcgcttggtttccgcaggttagagtctcagatgcattgttacagctgcacaaactaccctaccccgacagtgcgtgggtgccggagccttggtccataagggagccttgtgggcagtggcttaggcaagagcctgactggtgtcatcctgtccacttgtttactaaaaccctctgctgtggtcattcattgctgaccattcacataggacagacatatcttcatgatttttgcccattcgcgaggcctattcacatatcttttccccaaatatcttcaccaccaatttttccaatcgttctttccatgtctctgaccatccagcataaacattgagcacagctggcgaaatagtccatcactgcacaactggccactgctccttctaagcaaagtgcacagccaggtgcactgcctgcagctctgcccaggaggacttcccttccccactgtctttcagggacgtcccaggaaggggctgtagttctgcagcatccactttcaggtggtgcctgcatatggggcagagccgtctgtaaaccaggcctgagtcatctcttcctctgtcagatatcatggggacctccccaggaggtcacaggctcaggctgggagagagggtctcagctgagaaaggcggtggggcaggagtggggaccatgggcacttgggccactgcttcatgtaacctacttgagcattcaggggctgattgggcctaatcacatacataccacttccattcgatgacagagtgttgctgtgcacacctaactgtatggcttgttgggtcagataacaccctctgacaccaccctctgacacatagacgtctcaccgataaatgtagaatagttgctacttcttgctcactaagtccaatcagcatgatgtcatcaatgtaatgcaccagtgtgacatctcatggaagggaaaagcaaccaagattcctgcagactaaattataatgtagggctggagaattgatgggacactccctgaggtgggacagtgaatgcgtattgctggccttgccagctgaaagaaaactgcttctggtcagccttctggacagggatggacaaaaggtatttgctagatcaatagctgtgtaccaggtaacagaagatgtgttaatttgctcaagcaatgaaacgacatctggtacagcagctgaaattggagttaccacctggttaagcttatgatatttcagtcattcttcaagatctatctgtgttccctacaggccaaataggagagtcaaatgggaatggggtaggaatcgccagccctacatctttcaagttcctgagggtggcatgaatctccacagtccttccaggaatgtggcattgtttttgacttacagtagtcaccccttatccctggtttcactttccacattttaagttacctgttgcacagtacaagatattttgagagagagaaatcacattcgcatagcttttattgcagtatattcttctaattgtttgattttattattgttgatagtctactgtgccaaatttataaattaaactttatcatcagtatgtatgtatcagaaaaaacatagtatagctaggctttggtggtttatatgtccatagtttcaggcatccactggggtctcagaacacatcccctgcagataaaggggggctactgcattattttcccaggctaaagcagttctagtggcttctgcttggtcttcttcactgtaatagtccttactccacaggtcaggtacccagtgtgtagatgctaccagctcctcagtatgcctcttccaattatgcattctggaatggggaaataactacaggatgggtttggggacccacttgacccactgtaaaatgaacctgagctaaaactccattgatcattgagctccataagcccctactctgcctgggtggccacagtgaccttttcaatcttctggaatcaatgtcagtgcagatccagtgtccagtagtccctgaaaggtctgagtccctgaaaaggtaaggtaggtccctttggaggaggctggggaaaagattaagagtatacatttcgggtagtgtaccagggttgttttccaaggcgacattgttgtcccttcattcacgagttccaagtctgtaaattggctcaggtctgagaattgaggggctgtaactctctgctttgagagaatgattttatgatttgaatttgacttctgttttagagactgggtctcattatatcacccaggctagagtgcagtaatgtgatcatagctcactgcagcctcaaattcccaggctcaacagatccccctgcctcaacctcctgagtcactgggaccacaggcatgtgctgctatgcccagattcgacttagacttttattcacttgatctaaaacttttctgcttatacagatcacggcttctaatcaaatccccttccaggagccccatgataacgggccagagccatgagtctcatgagccaggctgttctgattgctgctgtgccactcctgcccattgctatacccgcacccacctcgctgtggccctgacagctggatccagttgcttcccttgcacttaggtttccagctgagtggctgtggttcccaccgtaaggtctgacctacagagaagagttatggcagagctcttcaaggaagctggggccccctcacacagttctttctcaaggtgttagtgaaaggctgtcttccagaccccccagcgtgggtgagtaggtctgaaatgacaaacccactctaacacatcagcctccctagccctttaagctccctctacattaaacttggggagattggatctttccagtttgctcacagcagggcagactatcttttgacccctgttcagccatccaaccaaacttcgccctttctaactcactgagctgcaactttaaatccacaatatctgcttactgagcccatatcaataaatttggcctgatccaactttatgttccttccactaccatctcacatccttaatattcattctcacctgtgttccctggatttccacttgtataaattagaaacccatgttgttcttttggagtgcaacataccttcttgtgggtcacaatttgtccctcaccttcaggggccttctggggtttgggtctagttataggtctagaggcaaagtggggtggtgaggctgggtcctgaaaagaatcagcattgtcccactttgccaccacctcagaggaagatatgactcaggatgcgggggactcccacaaatcaggtggaaaggctataccagtattggcagggatgctgctgccactggggatgtgaaggccactttgtttgagggttggggggacctcttccactggcaaagaatacatcagaatttaggagctcgatacccccagcttcatcagggtcttcccacatgtccccattccaacttacagtatcccattctttcccaatccatttccccacttaagagtagacatcctaggagactgggagctcaacttgcattgaattaataatttggccaattgctggatgagatcctgagtttgattttcagaaacttcagccctgtgcttgtatgaaataaggctcttggggcacacatagaaactcttaggtcacttttgtggctcttgagctgggaatttgaatccctgagctcatctttttcttttaccactttgtgcaatgacattagaagcaacaaatgtcattatattcctcagttttcctaaaatgttcaaaagtatcatatacagagtcatgtagctccttgcttcttataagtggtttattaggaggatccaatgcagatagtttgcatatctctatagtttatgccatgggtgatcagtgctctctttactactggaagtagaatcattagtgtctttacatatagtctgattaaagatccaattccagaaactccaggaagaattcagaaaactcatcctcaaaattctggtcctctagatccactcttggtaccaaaatctatattagagttctacaaagaaacagaatcaatagaatatgaatatatataaatatatatacatatatatatatagagagagagagagagatttattataggagttatgtagttacggaggacaagaagtcccacagtctgccatctgccagctagagacccaggaaagtcaatggtgttattccatctgagtgcaaagactagagaaccagaagcaccaatgttcaagggcaggagaagatggatgtcccagctaaagaagaaagtgaattcacccttcctcagccttttgttctattcaagccctccatggattaagtgatgcttgctcactttgaggagggcaggtctgtactcagtctactgactcaaatgttaatctcttccagagacaccctcatagacacatgcagaaatgatgttttatcagctatctaggcaacccttaatgcagtcaagttgacacctaaaattaaacatcacaagcagggaagatggtgtgggaggtgaggtgtgtctgtgagcagaagctgggtgggtctctgcatgaacatgtaggtacgggtgcaagcatgtgggagctgttggtggcaaaactcaacagaatcaactcatatttaggaagtgaatcagatgtcccatcctctgagccctgtgacatttcatgatctggagcaataaaaaactctcagagcaagatgtataataaaaagctaaattttcaagtatggtttttggaagaatgtgacttctgacttttaacaaaaagcagaaacaaacactttctttcatacttaggaattgtctgccaggcttctggaggcacctgggccgtgtgggttcacagcggtcatccagggaatggatggacatggtgagtttctgaagcacgggcatcacccttagggtagggggagggctccaacaccaaggcccccagcacacatttcacaaggaaaaatgaccgtgtcgtgcctgt

SEQ ID NO: 259 - DNA, 279666 bp, Homo sapiens
ttgggtttgatgaatattacggagcaacgttgcagtgtattttaaaattatactcaagaattcattttgtgcaccttattttaatgccgtatttccattcaagctctgcaacccaaaacagtctgtgttgattcttttggcattgaaaaaattatccatgggtttatttcatcatttcatggcagtaggagcttcaactgctatttgttgggaacccatcctgactagctatttcactggggcttcatgttttattgtgatgattggcagacttgtgtttcaggaatttttggctttggaaagttactatgattttgaaattatagatgcaaaaatgtcactgaatttattttcacaaactgttttaattcattatagacaataagtggtttaatcagaaatcaataatttaaataatcttttaatttgttggagcattcacaaatactacatcttcttttaagtctttcattattctacatgttatatacatagttaaattagttaataagagtgttacatattttccctccttctccaactatccacaagctgaggcttaaaataaacagtggaatgagtaaagacccgaagtaatatagcagcaaagctgtagttgaattttataataaaataatagatatcaaagtttcctgacgtttttaggcaaatcttcctgtgtccctaaagggaggatccccttgacaacagtcatgaacaacaggtgatcttgagattcccagctgtcaaagacagttagtgggaaaatttgaaagcaccttgtacgtatttttaaatcttagttgcatttctagttgtttttagtttcctgtggactatatttatcctgcaatcactggttttattggttgtccttcatattcttgtatttctctacatgcttgtgaatttgtattttcagcttcacttaaagaaggaaatatactttcacacatttagtcttccagtctttagtttccttaactccctttgccacgttccagagtcctcagtccaaagggacatcaggtatcaaggctcagtattccctgcccatgatgagagtaggatggctgatcctcttctcactaagccagggaggcagatattttagttcctggttatgtgtctcaaccctaagcctacacgcttaaaataagctaaacaccaagcagcataagaaacctgcctctctcagcttgctttcctctggatttatttgggtaaatctaattccaattctcccacctaggtaaggaagatgaagtcttagttatttcagaagaaaactcttggtgaatgttgagacctgttatcagacccctggctttgtcctatctgtatctaaattttctccatagcatttacctgcattgatacctgtttaaaatggaaggggttcaacatgttgggctatcttgattggaaatcattatttttttgtggaggggggagggcagggggtatttttttttgtactccaataaaaagtctcatcataaaggaattgtcacatagaaactcttgcccttagaaattgtttcctttgggtgtctacccattaatgggatttctgggtcaaatgggagttctagttttcgttcttagttctagttttgctctttgatgtggctctaaatggataattggaatgagagagaactcctctaggaaggaaaataaaatagaggtattggtagacacagaggttcttttcgttccatttacaaaattggtgggcggcaaggagcagtgctgctagaggtcttgctctgcccagatgcataaattcttctcctactaataagcactgcttgatgtcaacttcactgcatcctattactcattgtaggcatgtagcatgacaattaccccctacccctcttcctacttctggtcccaaacattatgactcagaatcaacccaggtgtccatcagtggtggattggatttttttcaaatgtggtgcatatacaccatgaggtactgtgcagcaacaaaaaaagaaagaaatccatatacaccatagaatactgtgcagccataaaaaaaaaaagaaatcctgtcctttgcagcaacatggatgcagctggccattgtcctaaagaaattagcacagaacagaaaatcaaatatcacattttctcatttacaagtgggagctaaaccctggatccacatggacataaagatggtaacaatagaccctgaggacttcaaaacaggggagagaaggagtgggctatgggctgaaaaaccttcctttcgggtactgtattgactatctgggtgatgggatcagtacaagcccagacttcagcaataggcaaaatatccttataacaaatctgtacatgtgctccctgaatctaaaataaaatagaaatgtaaaaaaataaactgtttcctatttagaactcttaataacatctcgggttggtgtctcttcccgatagaaaaaggtgtagtgtttttattctttttccattcctgggcactatcaagtcaccatgccttgaggatggacacaaaggcttcctctagagcagcaggaattacaaattgaattttataatcctgctacatttacagtaaaaggcatggatgaaccagctgtaaagatctatgatgctggtgatgaactatcttttctctgtggttgctggacctaagatcacaggggtgcttatctgggtctttagcaagagcagattctagttgcccgcccaacttttggcctcagatgaaaagcattctttggtctggtctttcctagccatgggcatagactgaacagcatctctcaggaagcacaattgatcttcagatgaaaatactaaaaaaaaaaaaaaaaaaaaaaaaaaaaaaaagaggaggcgttgtggagaaaactggtttggtgtaatctgccaacaattcttttagttcctctgtactggtgtgcagaggtgcataagaaagggattttttgctcagaattatttagtctatgattagttacttatagtcaagagtagtcatggaacttgttagttatgcgaaattggaccaaatatacttctttaagcctcatgactgatttttgtacaataacaattagcatattttgagcatttgaaaggagctagaggttcaatgccttacatgtggggttacatttgatcttcataggctcctgagagggtaggtgcagttgctaattctgttttactaaatgcccaacatcacacatagatgacagctattcctgagacttacaaaatgccagctcatgacattatgctatgctgcctcccgtacatcatacgggagtaattgtttctgccttactagttaactcagaaaagtaaatgaggcttggaaagaccctagctcaaagcacatactcaaaagtattagtttatctgcagcatggaggtgatatccacccattgagatgccagtcaaactctcctggggttttttgtcatcacctgctttccctaaactagcattgtccttgacacagctgtgtttgtggtgttttttcccctctgtttgtaggcatttttgtagcactacttatttgctgactcaagggctcagcttaagaccttaaacgcttcaggggaaatgttttttttccaaatctaatgctatgatttacatcaagtcctatagtatgacacggggcaggattgagacaatactctggctatgtgaatgaagtgcaggagactgtattaagaataaggattaatttatgtcttgtatcccatgtaagtcatgacgtttggggccagaagcagagagaggggtgtcgggcgtaattatcatgctacatggctacagtgagtaataggatgcagtgaagttgatatcaagcagtgcttattagtaggagaagaatgtttgcatctgagccagagcaagacctctagcagcaacaccccctcttccaatttggtaaatggaacaaaaagaatctctgtgtctaccaagacctctattttctttttcttcttagaggagttctctctcatcccaattatccatttagagccacatcaaagagcaaagatgtgggaataaaatctgtaacctgcacttctatgtgtctctaaagacctttagagtaattgcagatgagaccaaaagacgttttttaaaaagaagggtcagcttcaatcacaagatcagaaaaacctgacaaaccttaagtttctttgcaaaataaaagcacttttctactttaatgagaaatgatcagaaaatagtcttccctgtacttgcacacagtcatgtctcccaatgtaattggtagaaaatagctaaaagcatgaagcaagtccgtggagacatcacaagatcatgtaaatggattaaaagtgaatccagtttctttcgttttaacccttgaatattttccctttttttccgttctctttttacctttttctttgtttctactatcttgccctcttctgaacttgcaaggttcacaaaaactattctcagaagaatgcttccgacagttttcagaacaagatcccctcagcgattccaattaaagggcatgaaaaacagtaacaatcaccaatcattccaatgacaagttttaccgcactgctacctgggccaggacacaggttcgtggagttttctcttctcctggccccgtttaactccaatcttgctttggtttagaggctaccctatcttcaggtgctccctaatacatatcaggaaagtaaagcctttcaccttgagtcaccttcactagtttgtgtcatgatctttgtaactattggccttaccaacactctgaaaaaggcttaataacaaacaggttatgaagagaaagataagtgtgtgttttcaccttcttatttttatttctttctgactcttttcactgatatcccccaccccaccacagccatctgcagcaactctacccagcttccaaaatttatctatcccattgctactctgtgataatccccacagcatgaagtggtctctccttctttaagctatcttaccactattaccagacagtggctcctgatataatcacacatacatgtggatttttacacttcttagggggatagtagcctattcaagggtgaggaccgtaccttatgtctcagtatctatggcttatttagggtaggtgcgtataaactaatttttattgctgaaatttacaattagcagtgaattgtattttttgtgtgaagatttcctcacctactaaaatatttcatttatgactatgttcatttgaaatacaaggtgaaaatgaggtgaggtgcatgatatttcaatgcaaacgtaaaaacaaatgaaggcatgaggggaagagatccattttttaaaatatgtggttaaagtagtaaaatgattcaaataggtttctctgccccaaaatgccaggcttctctctctcttagaaatatgtcctgtgcatacctagctctatatgctttccacataattgccagcatgatgttcttccctctcctcattttctgctaaactccatcatcttaagtccaactgaagacccactttctccaagaaaatttctggactcacactccctacagtagagatctcattttttatcatttaaattggaatggataggccaggcacggtggctcacgcctgtaatcccagcactttgggaggccgatgcgggtggatcacttgaggtcaggagttcgagaccagcctggccaacacggtgaaaccctgtctccactagaaatacaaaaattagctgggtgtggtggctcgtgcctgtagcgggagaatcgcttgaacctgggaggcggagcttgccatgagccgagattgcaccacttcactgcagcctgggcaacagaaaaaaaaaaaaaattggaatggacaataacaaatgaagcttatatatgtcactactgtgctcctcatatataataataatttgtatatcttctactagtttgttttttaaataagttaagagcaaagactacacttttttcttccctcggaatttccatttcaccaagcaccaaaatttggtcacattttcaggatcaatgtttcattgttgatttttgattcatttacttacttttgaaataacttggttcctggtttttatcaggatatccctttcaaaacttgtattattctggagcattaatattgcaggctggacatcaaaagtaacagagggcccactctctgtgctttttttttcctttttttttttttgagacagagtctcgctctgttgcccaggctggagtgctgtggcacaacctcagctcactgcaacctcggcctcccgggttcaagcaattctcctgcctcagcctccttagtagctgggattacaggcgtgcaccaccatgcccagctaaaagtttcaccatgttggtaaggctggtctcaaactcctgacctcgtgatctacccgcctcagcctcccaaagtgctgggattacaggcgtgagccaccgcgccctgccatctctgtgctcttaaatggtaagtcattgactcatcctagagaaaagtctacataggctctcatagattattagagccctggatctggttttctgcaattctcttggtttttccaaatttcttcccttcattctggcatccttcttgatcccttgtctaccacaccacttaaatctctgtctaggaatgttcacgcattgtgtagaggcattggtgttaatggtattatctctgaatccatcccaccgcctggaagcaggacacccttggttttctatgtgagaggtaactcaagcagtcactatggaaaggaagcagcattcacatttttggtggttgctgtggacttatgcaaatcaggacccctcacccccactcccaaaaaaacccctctgatccaaatgctaatccctctggaaataccattacagagacagccagaaataaatgtttttccaactatctgggcatcccttagcccggtcaaagtcacttattaaattcatcatcatattttgtattagagtggagcaaaagtaattgcggtctttgccattgaaaatgatggccaaaaccgcaatgacttttgcaccaacctaatattagaactaaaatagtaatttcagagaaataaaggtaaaagtttgtgtgtatatatacaaaataaaaattaattttgtggaatcccatttatctccaccatagaattatttgatataccttcttttaattaaaaaaaatatagtgtttatggccaggtgcagtggctcacgcctgtaatcccagcactttgggaggccaaggcgggcagatcacctgaaatcaggagtttgagaccatcctgaccaacgtggagaaaccccgtctctaccaaaaatacaaaattagctgggcgtggtggcacatgcctgtaatcccagctactcaggaggctgaggcaggagaattgcttgaacctgggaggcagaggttgcggtgagctgagattgtgccactgcactccagcctgggcaacaggagcgaaactccgtctcaaaaaaaaaattacagtgtttataataaatctttaacatcttcaaataataatataccatgtcatgtgtgatgtaagacactcacagccatatccctaccctccctgaccattgtgctatttttaaaacacatttttcactttgatgtgtgtggtaaactcgtaattattaaactttgctttaaattgttaattatcttttcaagaaactttaaagtgagcaaataagtcttttataccctctcacatatttcacactgtgtctgtcacggtttggatggattcagtgttccatctggtaccactcccatcctacctgaagagctttctttagcatttcttgaagtgcaggtctgatggagaaaaatgccctcagcttttgtgcatcttaaaaagccttaatttccccctcatttaaaaatgatatcttcagtgtatatagaactgtaaactaacagttgtttttccccctttttcacactttgtgggggccattccattaccttctggctagcgcagttcctgtggatgtaagagcatgtgtgtcttaattcacagaaagagaaggctacatagcagttaacagattgactaaaattgatttatctattctgctcaagtggaatctaggtctgctaattcctacacaagtttgcctcaccaagatatatctccattattcacctgggtatatttattggggtgatagataacaaagtacctacagtaaactcatccaattttgaggaaagaaaatgtttaagtttaattgactaattcctcacagtaaccaaagggtttccaaaatgtaggtgtccacactgcttctttaagtttatgctacacttattggcattgatatgccattgtctgaatgctcctggaaaccacaactatggaaggagtgaatagagggtgtttcttctagtcaaaattttaacttcctaatttatttacttcatagctgaatgtgtggaactaacaagtttcctgactcttgactataagcaactaatcgtagcctaaataattctgggcagcgagttaccccctttttttttagatggagtctcgctctgtcacccaggctggagtgcagtggcgcaatctccgctcactgcaacctccagtctcccaggttcaagcgattctcctgcctcagcctcccgagtagctgggactacaggcgcccgccgccacgcctggctaattttttgtatttttagtagagacggggtttcaccgtgttagccaggattgtctcgatctcctgacctcgtgatccgcccgcctcagcctcccaaagtcccagaatgctgacattacaggcgtgagccaccgcgccgggccacgaatcccttttttatgcacctctgtacacgagtatacagtaggaactaaaagaaatgttgacagataacaccaaaccagttttcttcacaatacctcctctttcttttactattgtcatctgaagatcaactgtgcttccggagagatgctgttcagtccatgcccatggctaggaaagaccagaccaaagaatgcttttcgtctgaggccaaaagttgggcagggacttgacagtgcccaggaatggaagaagaataaaaacactacacctttttctatagggaagaggcaccaatgcgacattactaagaactctaaattggaaacagtttttttttttttaaacacttatcaggagtgattgattttattattattttttctttatttaactgggtaaacaattaatttgactacaatcagccaatttattttttagcattctgtatacacactcttaaaaattgtgttacattgaatagatgttttattgttgttgttgttgccaaaatttgtagcaaagagtttcacattttcatgacaattttaacatctgggaacattgttcagtagggacaatagaggcacacctctaagtcttccttctgtccccattggacaagaaagagttggggagtgttgactttgagttgtgcctagagaggaaaatgtgcatttattctaccagcttggatcattttttttttaagtaaaatggttctgtctcttagcttttcttttaaagagaacactgatatttcaggtaatatgtgaaatgttttgaaatgctcacaaatgaattatagattaaactgaaattacttgctttggtttttcttctgttgtcattgtcaagagctcccaaatgatcaagggtgaaagataaaaatataaaaaactaaaacaaaaaatatgggatggaaaaataaaccaaaaactattaagaagtaaagtctggttgattatgaagcaatgacaaggtccttagatatacagaaattgtgtattcctttcagaaaaagaaaatgatcttgaaaaatacctattactacccaaaatactacttacaatgtctaattgcccaacaacatgttaccgtgaatacagaatagaacatggtttgttccaaattgagtgcaatgaatttgaagagtaggtcagaaggatattactggtttgtaattatttgtaaatggcctggtttcagcttatagctgtcgcaaacctgtttgccagtaggtaccttagatattagaattcctgaaattctaattcttgcaatgcccattatcttatttaactaaattcatcaaaccacacataaaaaataataaaaatgaaagcatagcatcacaagtgaatttacttgggaaacttcatctttttaaacacctgatatgaagtgacctactaaccattacaggctattaccaaaaatgtcacaaagaaacaaaagtatatacaatttacagcaatcattcattattgatttaagaacactaattgaacttccagtataagccaggtaatgagtaatgctataaacaaataaagataaggaaggcaagttccctttctggtgaaggaatcagatggaaacatacaataattctagttcaatacaaccactgatatgctctctgagaatcattttctaaacatcttagcagatgatgtattagaataatcattacctataggtagattaccttgattataacagaataagtagttatcaatagataagttaaaaataatttatatcttgcatgctggaatcatttatttgcaaaccatcttcattatcttaaactgaaagttgtacctgtggtcttccagaaaaggtcgtaactcaaaagtgtctaggcttagtgaaaaagggttgtggcaaatatataaataggcaaaaagacaatgcatcagaaaagagtatagatactctattctcagaacagtggccttaattttaccaatttctgaaagcaatgtcataatttcaaacaaaaccaaatatttatggcatagaaatttcactttgatgtgacagtcacacgattcttcacaagattttattggctcatttctctatttataaaatttttcctctatgcaactgtatgttattatgaaaattatctgttcatgatatattacataaaaataagcttaaccattcaaaattatctattctttatctattacataaaaataaccttgtctcctgctttgtgttatgcaaatgctagaattttagcatggaaatcagcctaggcctgcacttctgaaactttccagtgcccataaacacctgaggatcctgctaaaatgcagatgctgattcagcagggatggggtgggcctgagatgctgtgtttctcccaagctcccaggtgatgctggtccatgaaccacacctggagcagataaatcagtccactacatctgacccattttgtttaaatcatcactgaaagtggtcctgatcacttaactacaatattcaatcctggggacttccctataccctttcaatttacaaggcaattagttgtcatgcctgtcaggagatccacaaaatcaaactggctttcacttattcccttgcacaggtttctttaaagagatttcctaatttgagaaatcttgggcaaattgaaatggtttaccatgcattgttgtggtctctatgactgccattacaaaatgatgagtctaaaattaacactactcctgaggataaattagaaccatttgctgtttgtttctttttgttttagtgtaataatggttgtaggctaatcaggaaagatgctggacacatgtgattctcatctcatctaattaaattgtaacacttaaccattaaagtgaataagctgcatcatagttttatttttcctaacaattataatttctgcaataataatattatctacaacttattgaaggcttgctatgtgctattttctgtataaaatttaggcattatttcactattttgctgcatggaaacccacttctgagaggttaatgcatttatttttttctaccacttacagcaagttaaaaacaaaatgtctctgactatagcttagctctcaagctgtcatttgactgtaccctttattttgccaatagaaggaaagctattgctatcgcatcttggaggcagatatgtctactcattttcaccttctcctttcctttccctaggggaagtccaatttttcatgaggttatctgttggtcattgcagctgagttgccagggatgtcttgggcatggaagcctagggttgagacccacctaaagctccccaatacttttctggggtcccagaggaatcaggacactgtctgcatccctttttcttttcctttttttaattgtatttttttggagttggggtcttgctttgtagcccaggctggagtgcagtggtgcaatcataggtcactgcagcctggacctcctgggctcaagtgatcctcctgtctcagcctctggagtatctgggactacaggagcatgacaccatatccaattaattgtttttttatgtttttagacatgatatctggctatattgcccaggctggtgtccaactcctggccccaagtaatcctcctgcctcagcctcccgaagttttgggattacagacatgagccactctgcccaactccaatccctttctctgattgccattttttactctcccatagccatttcatacacgtctatgtttccttctgaaggacaagactgcctattctaagaatttcagatgagaaaaaaaagcctaaatggtattttattgctccatctgcctcctgggaaagaacgcactttcctaccccaccaacacagacagtgcagtgacatcccttccccactgctcctttctgttgcaactcccatctcctttgcttgggaggtgttcatttcattgtgcatttctctcacttgagagttaaagacataaccttaatgttttgagctctctgggctttgcctcttgatatttaaatgcagaatttggaataaaaagaatatttctgctatgagctgaaagagaagtcctactttgctactcaaagccacagatttgactctgatcttgctaggttctgttgagcctgtccatttctggggcaatacccttctgcccaaatgttgattttaatggtgaggatttgcagaaaataaagaagaaaaaaaagcgtcagatatatttcaaaaaaaaattgtaccatagggcacattcatgggattagaaataagagtgcaaatctgaacaagatggtttcggacagtggtcattccaaaaataattaagcaactgacaggttttgtttttttcttcacatgttcagttgcagctttagaggttgaatcaacaatctgatttgtttatttaattaatttattttttgacagggtcttactctgtcgcccagactggagtgcagtggcacagtcaaggctcactgcaacctcgacctcctgggctcacgccatcctcccacctcagccccctgagtagctggaactacagactacaggtgcgcaccatcacactggctaatctttgtatttttagtagagatggggtttcaccatattgcccaggctggtcacgaactcctgaactcaagtgacctacctgcctctgcctcccaaagtgctggaattacaggcatgagtcaccatgcctggccagaatccaaatttgtaggagatatatatatacatatatggatatatatattaggatatatatatatataaatatatatataaatatatatataaatatatataaatatatataaatatatataaatatatatatataaatatatatataaatatatatataaatatatataaatatatataaatatatataaatatatatataaatatatatataaatatatatataaatatatatataaatatatataaatatataaatatatataaatatatataaatatataagtataaatatatataaatatatataaatatatatatatataaatatatataaatatatatataaatatatataaatatatatataaatatatatatatataaatatatatatatatatatgcttctataactttatttgaagtccaaaagagaagtgatttatttgaggtaaaatatcaccaaggttttatagaagtcatgaatgagactcttgaaacaatttggaagtgttaatataataaatccaaatttgttttccatttgttttgtttttgtttcctattctctttaatgaagaagcatttattatctagatattgcctcccaagtctaggatgaatctttttttcttgtcattttaaattgctgctgaaggaaaatttccattttaaaaaacctaaagcattttcgagatattcttataattccaagccaggcaaactgatataatttatattaatagtataaacattgacaaccataatgtattctttttccacaagagcatatggtttggttttgtttttcaccaaagttatgagtgattgaaagcagatattttgctaaaatgggtaggtaaatcatacacgtgcttggattcacactgaagtgtttgcagagtgtttaacacgaagctggggacaggagcctgctggtgtcgcactgagttatcatggtaggaaagtggtatcgtgtgacttgtggcactcctagaatgcctctgtgagctattgcatatgcacgcctgatggagaaagctgaccagcaggacactggcttctcatgaagtccccgcactagcatttttaacatgctcaagatttatggctcatgaattcagagacagaaatacaaatcttatgactctagttacttatgtaagacaataccaagcaatccatctctgcagtgtatacaggcactgaagggtgctgggtcttgaattttaaagtgctcacccttgcatttgaggaagtatggaaaatcgcttagcaatctccattctccactgtctcctagggatgcttctaactaacgcacacaaggaaacagggacaacaaataaacttacaggcttaggaaaataataattccacttggaatgttttaatttggtcgtttctacgtcaggaaatgtatactgcttttctaatggagccacactgtggtgttattcaatgatgtatgtcttctcatctcctctgggatttttttctgaagaataaaacattctcagctcttctattttaccaaaatatatacagttacatgatgacttaaatatgcacaactccatttctccatcttagcattattcttattttaggtgaaaaaaattcatagtaatttagaaacaggcaagatgcaaataacgtcatggatagtatatgaggtttccagtgaacatcatacaaagtaagctatctgtgtcactaattgatctcatgggaaacgtaagtagtatagaatcaagatcaagtggggatgtatcatttatgttcaagatacttctcatgttcattttaaatggcttcgatttgggatataatgaatttagttggagagtggacagcatacatgaggtaaggccttcatgggcaattaaggtacataacttaaaaaaaaaactgttccatgatgtattacttttaaaatttggccctcattcacagaacggagcaggagtgtggggcagtgacctgggatcaggtgtcacatgaaaagcggatttgtgttgaagctggcttccactgtacttgacataagattgacacatgggcagctgtcagtaacaaataatggatggagcaggggatgatggcgatgagcttcccattgaagaagccatttgtgtcatctctgtgagggccacacactgtactgagttcattttctaagaacaaggttttcattctaacatgatgcatctgggttcgagaggcatcaggagcttgctagttgaaagaagaagcatctcctctgctttagctaccgaaagtaaaatgttgaaacatatgcaaaagttatctgcctagccattcctggtggtggtgattcatgtgagagctgccaccagcaaagctctttcatgatgttcttttcagccttgaagaggctctaccatagtgggatttcaaaactcttaagaagagtaaagcactaatataatacttcagttttaattatcttggctaaccactttctgcccatttactaagtccctgagtgtatcattcaggggttagtgtagacaagaccctacacttcttttaggacagaaggagaagaaatcatttgagactacgttacaggtattatattcattgactgctaaatattttgacatcttttcattaagtagataaaactgcatataatgttctcaaacctcatctgaaaatacaaataagaaaattggccgggtgccatggctcacgcctgtaatcccaacactttgggaggccaaggcaggcggatcacaaggtcaggagttcaagaccagcctggctaagacggtgaaaccccatctctactaaaaatacaaaaaaaattagctgcgcatggtggcgggcacctgtagtcccagctacttgggaggctgaggcaggagaacggcttgaaccggggagatggaggttgcagtgagccgaaatcgcgctactgcactccaacctgggcgacaaagcgagacttcatctcaaaaaaaaaataaaaagaagaaagaaagagaaagaaagaagaaggaaagaaagaaagagagagagagagagagagaaagaaagaagaaagaaagaaagaaagaaagaaagaaagaaagaaagaaagaaagaaagaaaggaactcattggccatttatattattcaaacctatttcctgcttctaacggttccactgcctctgtggtttcccttcagacagggggactaaaggatgcatttttcccatatagagaaagattattggcacctaggatttctggcctaaattcctcaaaatgtaagtcatgccgatactattcctgaaaaatcgataatgacattgaacttgatgaataacatgaacaactcatgtccatgcaattaaacttgaattctgttactgaaagccaagattgaatgtattatttttttcacatttcatttatttgataatgctacttctgtgaacattttgtggaaaatttggaataaccacaggatgaggtttgcatcacattatattacagttcaccatatataaataagctcattgtcaaatgtatattattaaagtttgaatcgagaaaagcataatagtttccagcttttacattttggtattgggctttgcaaaaaaaattgcaattgctgttaagaaggcatcctagacattatgcaggcacaagtggtgtaatcccaaacagcttaagaaacctaaatattgttaggtatggttctgcttaaggtaagtttccctgcagttcatgctgcagggtactgagctgtattcttgttaaatatttaccataagttactgtacttcatttctgtttcccacaaactgagtcctgtgtatcagatagcctaacaggacagcacaaatctttcagaaagtgagatccactgctgaagtcaattcagccaaaaatttcatcagaatgagctaaaaaaaacaactgattacccagagatgcatcattgtttagatttatttttgattattccaactttcgtttctggttctctttttatttttataaatttttattttatatattttcaagcacacagaaaatatcaaagtacagtataaaatttgctgtaaacattcaaccagatttaggacatgttaaaaatttcccacagtggctttgctctatctatgttattgtggttttttgttttgttttgttttgttttttgacagagtctcactcaggctggagtgcagtggcacagtcttggctcactgcaacctctgcctccctggttcaagcagttctccctgcctcagcctcccaagtagctgggattacaggcacccgccaccacacctggctaatttttatatttctagtagagacggggtttcgccatgttggccagactggtcttgaactcccgacctcaggtccgcccgcctcagcctcccaaagtgctgggattataggtgtgaaccattgcgcccaactgctttgctctatctgactgtctatctatctatctatctatctatctatctatctatctatctatcatctacctatccatctatttgtatctatctatctatctatatctgtctatctgtctctctgtctatctatctgtctgtctctctatttgtctgtctggctggcttgctggctggctatcgtttgtctatctatctgtggatctgtctgtctaactatctttctgtctatctgtctatctatctgtctatctgtctgcctatctgtctatttgtctgactggctggctggctatctatctatctatctatctatctatcatctatctatctatctatctatctacctacctacctacctacctgtctttctatctgcctgtctacctttcagtctgtctacctttctgtctatctttctgtctgtttttctatctgtccatctgtctgtctgtctgtatgtcttttcgtcctccgtccatctatctgtctatctgtctttctttctgtccgtctatttttctgtctgtctgtccatccgtctgcccgtctgtctgtctgtccatctatctgtctaagggacctgtctgtctttctgtctgtctatctgtctgtctctctctctctctagctacctatctacctatcatctatctgtcttctctcccctaagtgttttcatgcacacaaatacacacataacacacacaattctatatatctatatatgtatatctatatatgcatatacttttctgaactacttgaaattaagttgtagatatcatattcacctaacaccaaatattttggtatgaatttcccaaagataaaaactgcacgaacctgatacaattaacaaaatcaagacatttaacattggtacaatactatctaattcattgatagtattggtatcattgataacattggcgcagtactatctaattcacagtgatactgaaaatttcttcattattgctatactgtcttttttagctatatttttttctggtccagtatccaattcacaatcatgaatgacatcacattgtctggtaactttactttccttcagtctggaacattctctgtttcttgtttgttcatgaagctgatatatctgaagacaggccagttattttgttgaacatccttcgatatgagctggtttaatgattcctgataactggattcaatttatttatttttggcaggagtaccatcaaaatgaggtgtgttttctctagtaccttatgtctagatgcacatgatgcctctgtctcattattggtgatgataaacttcatcacttggttaaaatggtgtctcttggatatccccgtacaaagttattaattttacctttgcaatttataagacatgtggtattgataagaaatcaatgggctatttcagactatgtatatatcatatcttgttcatcaaattaattttgtcatctagttggccttgatgccaatatggtggttacaatacaaagatttcccaactccatcattctttatgtgtttctcacttggctatctgtgaggaagtgctttgcattgtcttctatcattctattcactatccgtatgaattcctggatattacaagtgcacttttctgaagttacccctttcaaaatggcacctgtgtaattttgacactttccaagcatttattcatactttctgacataacattaccataattcctcagatgtcaaaatgaagataaaagtaaatctagaatgatgatctccatctattaacttattaagagaatacattgacatacatgatgataaatacttttatctctaacaatgcttctaattgtttgtgacattcaaaattaatgcagataatattgcagagcacgttgagtctaaggccactttagtttttgcccaaagagctttcaacaagagagatgtccacagtcttctttgaatatataaatcatgtctacaaatcaaactcagtaattatgctgtgctgaaatatttgcataaaatatttgaatacaatcagacataatctggtacaaatggtggcaaaataattatttttatgaaaatccgagggtgttttaatgtcataatttagcctctgggtactaatttattggtcacctatttcactgttaccaaagtcttctcaatgattaatacctcagccacttttgcatagttctaggggttgagagtaactatagcattttaagagcacttatttcactaattgacattttctattataagcagagatcctgcaattctctgccttcttctttgttttgacttcaagagctgtaacaaatagtgaatctacttcctcttccatacaccactcctttaaatatttgaagagagctcccgtgttctgttggatactgtcattctttgctaaatactaccagttcccaattccatttttcaaaagtgctttcaatgataatttgctctactctggatactgttgagtctgtcacaaatggtaacaatgctgattaattagtatagtgacctgaactaccatagttgagaagaaaataagaggttacattcaggcttgttcagaaagagtgcagctatttgatgtctgtcaaaatattgtaggaggcagggcacagtggcttgtgcccttaatcccagcattttgggaggcgaaggtaggaggatctcttcagtctgggagttcaaagcttgggcaacatagtggaaccccatttctacaaaaagaaaaattacaaaaattagccagaggtggtgatgcatgcctggagtcccaggtattcaggaggctaaggcaggaggatctcttgcatccatgaagtggaggctgcagtgagacatgattatgtccctgcattccagcctggatgacagagcaagaccctatctcaaaaaaaaaaaaaaaaaaaaaaaaaaaaaaaaaagaccttgtagtagacagtggtgtttatttgatatcctatattgtaaattaagacaatggcttagatataatagttagatgtggtctagcctgggtagcacacatgtgacattttataagaaattattctaatatgctgatttctaaaatcagttagaatttatcatattattagctcagaacaaatttgtagtcaactaaaatgtcaagatttttgtttttcctgtaacatgcttttgggatcatggtttattatataatcttattattgctagaaggcttggaaagtctcttggttggacaaattaagaaaaaaatatataatgagatgacactaaataaataaatgtcatcttgccatttacctttagcaaaattttcatacagaactgcagaatgtgtgagaacttatttcacttttgtttatataaaaattctttttaatgtttcaaaacatgagttacatcgaagttttcaagagaaaagttgtatatctgtatttaatcttcacctatgttcacctaactaaaaatatgaagcagttatactgcactaacattttttcacaatgttttgctatcctaaactatatttatatttacttttcatttacaatgtgcttgtccatcctattgtgtgaataatagcaatttttagggatgaaatagtaaaccataaggctatgcaaaacctaatggaaaagatctttcaggggattcttttgactaaagacagatgtgacagatgttatgaagtcttttaaaatttttcagaaagtacaataagtgatatccatagcagtcctgcagtctaaaatgataacttttgaaaagagaaaagttttggcaaactgtaaaatagaggtagacattgccaaagggaaaaaaattgctttggtttccacatatcaaaacactttttttcaacacatcaggtcaaaggtatgacaaaacgtgccttactaagtatccggaaggccttataatgctgctttacaccaaggaggtggttgctacagcccttcttttggaaaactcagagtgtgaggcccagttattctcttgcaaaaagctactggctgtaaatgagtggtttaaaggctgcatttgattctactccatgcactgaagtagcttagcatttatttaagattgcagtacagcagtagacaagaaaacaaaaaacacaaaggtaaatgttccactgtatatgtgcaagggatttcgctggaatatacatgtgcgaatatgtgtgtgtgtgtgtgtgtgtgtgtgtgtggagagagagagagagagaaagagagagagaaaacaccagaagatgagaaactcaaactactcagtgtggttgtagaaatgcagcttaaaaaaaaggtaattgaacattaaaacaaagctgtttgcaataagacattttcatgagctatttatgcctcatataaattctcatttcttgaaagtaagaccaaagaaatgtttaacgaacctttctgtattatgcagacctggcatttattatcagagactgcgcactgtacaatgaagtaaagccagccattcattaggtaaggtgtgtgtatatacacatatgtttttttaaataaactctttgcattgcatgtagttgaattacagatcaagtctgcatgttctcttccttccaacatgacttaagaagacccgtaagtaattgataaggctggccatgctttcaaaactagctagtgaagacttgctaaggggaaaaatcactatcgtcctgttcatttttattttcctctgttaagaggcaactaactgaaaatgttaacatttagagaaataagtgatgctttttagtgtgtctccctgctgcacactgaattcacctctgtttccacatactccatatttgccacaatcatttctgccttccttcttaaattaagagctccttggtgactggtgacaaaaaaatatttgtggtggattaagatccctctaaatgtcagctcttccacagacattattttattctcacaaaagtgctgcaagataggtgtttgtttgtttctttttgagacgggctcttgctctgtcacccaggctggagtgcagtggcgcgatcttggctcacttcaagctccgcctcccgggttcacgccattctcctgcctcagcctcccgagtagctgggactacaggcgcccgccaccaagaccggctaatttttttgtatttttagtagagacggggtttcgccgtgttagacaggatgatctcggtctcctgaccttgtgatccgcccacctgggcctcccaaagtgctgggattacaggcgtgagccaccgtgcccggccaagataggttttattatttccaatttagttaatcagacaataggctcaaagaggccaattaaccccctcaagatcacacaacaaatcaatttgttggtcaaattgatcaagtggtcaattttgggctttaaaccaactctgccaaaaattactatcggagacatttcaaccatcaccatagatcatgtgtattaatcttagtattctcaggaactgatggtgcttaatctataattaaggtaatttcagccaatatttagtaaatacctggttagctatttccaggtaccaaaaggtagaacacaatactttctatttactgagaaattacctggccaagtagttttctggagttgctcacattcagagatgaagtatagtgaatgcattacagcagtcgccttatccacagtttctctgtctgcagtttcagttacctgcagacaactgcagctggaaaatattgcatggaaagttccaaaaataaacaattttcagttttcaattgtgtgccattcttcataacatgatgaaatctcacactgtcctgctccatcctgcctgagatgtaaattatccctttgtccagcatctccacgctgggcacataactcgctacccaccaaagctgggcacataactcgctacccacccaagagtcatggacatcatctgctcctgacattcacccattagacatcatcatagctcaaagatctgggatcacccaaagcagatgaccctccttctgatgctttgtcagaaggtcaatagtagactaacactactacatcacaacgcctgtgccacaatgcctatgtcattcacctcgtttcatctcatgaggcaggcatattatcatctcacaccatcacaagaagaagggtgatgtattagtccattttcatactgctataaagaactgccaagactgggtaatttataaaggaaagaggtttaattgactcacagtttcacatggctggggaggcctcaggaaacttacaatcatggtggaaggtgaaagggaagcaaggcaccttcttcacaaggctgcaggaaggagaagtgctgagtgaagtgggaatagtcccttataaaaccgtctgatctcgtgagaactcactatcacgagaacagcatgagggaaaccacccccatgattcaattacctccacctggtctctcccttgacacgtggggattatggggattacaattcaagatgagatttgggtggggacacaaagcctaaccatatcaggtgagtacagtacaataagatattttgagagaaagaaggcgatatcacttaacttcacaagatactattataattgtttaattttagtattagttattgttgttcatctcttactgtgccttatttataaattaaactttatcatacatatgtaatgtatgtaggtataagaaaaagcagtgtatatagggttcagtactatccttggtttcaggcatccactccggatcttggaacatctctctcacggacaagagggggactactgtaggtgcctattgccatgtaacaaaacatctcaaaatataatggtgagaaacattatatgtattacctcacagtttctgtgggtgaggaattttggcattgcttagctgagccctcttatgagcctgtagtcagccgggacatcagtcgtgtcaagcctaggtggatccttttccaagctcccttgcaaggtgattggtgggattcagatcctcatgggctgctgcacggaggccctccattctttgttggctgttgaccagttctctgtcatataggcctctccatggggcagctcacaacttccttcatgaaaacaggtgaggaggcccagaaagagaaagaagaccataaagttagagtctttgtggcttagtctcagtagcgtcatcccaacacttggcagtgctccattcctcagaagccacttgctctttccagcccactctcaacaggatgtgattaagcaaggcgtgaagatgagggagcaggtatcatggtgtgccatctcagaaggctgctgacagcaacaaataacagaagcgaggccttggaagtgtttatctgcaacaggacaatcacagttcaccatatatgaaagagttaagtgaatttttttcaggcataataactccagctgacacccaaattgggaacatcaaaagtcactttctaagcagaatcatatcaatagctttaaatatcaggcaagcatattccttacaagattttttttgtagcatttattataacctcttttgagccctggatattatgcaaattaagtgagcattgtgtatgttttcttggctggcactcttgagatatcaaaagtgtgaaagagctggcactaaatcttggccttcagctctgaaagctctaaatgtaagtaaggggaaaaaagtgtgcatgtgtttatacagaatagaatatgaaaaagagcctagttttctttcttaacaggattatgcaatttaaaccttgttttcaaccacataaagacatcctttttcttgaatgacactattagactggaaagtgttaaaatatattcccttgaggttttctgtgagatcggcctagacactatacactaatgatgacaggatcaaggcttataaaactttagaatattctgatttttagtcgcattacgaagacaagagcctcattatctttcatcatttgtacttctgaaatactaatgtatgcgttgctcttctatacattattaaatttcattttaaatggaaaatgttaatatttaactcaatagtttaaacactattaatactaatgttgtctttctaatttctagagggaaaactttccaacttcaatttgaatcctcttaacttttatgttttcactgttcggaaagcatactctagtggcatggattatcctgaaagcaagataatgaaaatgaatttatatctaacctgaacgtgtttggggatttgagtatgcatccctaacatgggagaagttcacaacaattgaaatagttctgaaacggagctgtaaagactggactcaagacaagcagacattttccatcctactggtctatccctttctgcaatgctcttcctatttatctttcttatcaagatatcctcatctctgaaatggacagaagggtctttcataggaagagttgctgtgagctccttttagggattttgaacttgtggacattcactctaagaatgcacacataaatgcactatagtaaacaagtgagtaaatgaggaaacctgggcactcttcttttttcctttcattcataaacgggcatttcaaggcggttatttaaagctcatgtgaatttcaggaagcagttgctgtgcctatcctctgtggttccatagcacccactataaacatctaatagactgcattgaaactatctttgtatatatctatatgcccaactggattcctaggggaagagattcagcatttttcttctctagtacataacataatgtctggcatcaaccagatgttcgaacaccataaaaccatcaccaaccataaaaataagagcacacacgacgcccagatctctaaagcgtctggagtggtgttttggactggcagtgtagatattttctaatataagcattaatacagggaaagccagcagcaccttgacaaaggaaataattcagcctcctcttgacaaacatgtgtattggattttcccagtttcaaagccagaaaatcattccatttacctcaaacaatgaggatacatgtgaaaataagaaaccagggaaatcaccatcaagatgccaccttgcggaagagataggcagctggaatcactaagacgccctccctgcaagaacacgaacccaagtataggcagaataatggagagaagaaagcttgaatgacaactttgatcacctatcatcactttgttgctctcctattctcagaactttagtatttttcactactacttcctcctctctgttacattttctcttctgtttctaccaccagggaagtgtttccctctttttctttattgttttttaaatttatttatttatttatttatttttgagggagttttactcttgttgcccaggctggagtgcaatggcacgatctcagctcagcacaacctctgcctcccaggttcaagcaattctgtctcagccttccgagtagctgggattacaggcatgcaccaccacgcctggctaattttgtatctttagtagagacggggtttctccatgttggtcaggctggtcttgaactcccgaactcaggtgatccacccgcctcggcctcccaaattgctgggattacaggcgtgagccacctcgcccagctgcgtctctccttttgttgaaggttttcaaaatattgataagaaatttatgtgtaagaagccacctagatcttttctctcagtggggaactgtgggtgatggcgctttccccaaaatgggatgtggtggtgtgcagactcctggaattttgcaaaacccttattttgtttgaactgttttccttttagtcaaatgactttcaggccagttttcattatatggacagaccatagttaagtcatctactgtgccacaattgctacaataatgctgagcaaaagggatcatccaaaaacccagccattcataacagaaaacacttgaacattcatggctctgcaggggagctggggccactctgcttcaagcggcagttggtattcatttaaggttcatgtgccattccatcctttttttattgatggctctgtggacatgctgtcctgacagcagatcgcaggaataccgcagtgggaggggaaacatgaggcttcctgagactttggccccaggccggatccttacgccatcactcaattcccactggccaatccaaatcctctcaccaagcccagtaccaccatggcaggaagcaaaggcggctccctgctgcagtggacagcattgcagagccactatcctgcatgggtgcatcattcttggagcaggaaggctggaagaattgagaacagtaattcagccttcccataatgatgacttagctctgttctccataagcctctagaccaaacttgtccaacctattgcctgcatgcagcccagcacagccttccatgctgcgcaacatgaatttgtaaactttcttaaattattaccagattttttctttttttttttctttttttttttttttttttgctcatctgctattgctagtgtttgtgtattttatgtgtggcccaaaacaattatttttcttctaatgtggcccagggaagccaaaagattggacacccctgctctagaacttcagggatatgtttattcattggtttattctccccaggtatattaagagcataacaaaaaaagaaaaggaaaggaaagagggggaggggagagtggggaggggagatttggggaggggagggacaaaggaagaaaggggggaaggaaagaaagaaagagaaaagaaaggagagtagaggaagaaatgaagaaagaaaaaaaggaagaagaaagaaagaaagagaaaagaaagagagaggggggagggagagagggaaggaaaggaaaaatgaagagagaaaagaaggaaagaaacagagaaagagagagagagaaagagaaaagaaagaaaggaaagaaaggaaagagagtagaggaagaaatgaagaaagaaaaaaggaagaagaaggaaagaaagaaagagaaaggaaagcgagaggggggagggagagagggaaggaaaggaaaaatgaagaaagagagaaaagaaggaaagaaagagagagagagaaagaaaagaaagaaagaaaagaaagaagaaagaaagaaaaaagaaagaaagaaagaaagaaagaaggaaagaaaaagaagaaagaaagagaaagtcttgagttaaactaaatttcattggggaaaaatcaaaacattgttaacccacttcatagagataagtaattataattgcttacatatatgtgtatccagtgtgtttcttcaccaacattttggtaacaaaaaacgtagcattatcatgactacccagcatttaaaaccaagataagtggttgtctttcagattatctacaccaccaactgaatagagaggtgttcagttgaaaatgcaaaatactttaaatatttaaatattgtatccccatgatcccaaaatgtgacattaattattttgagtagttttttattaaatcaaaagaattcactgaatgaatttgtcttggtacacactttgacactcaagtgaacgcaacctctgaaatcattcttgattaagaaatcctgaaaaaaactcatctctactagatgactagataagccggaaagaggctttggtcattttaaatagaaatgctctcgttattcttctaaataccgtttgagaaaaaaccagatagtataatgtgggtttcatctaaattcatatctatttcctttctaagcatttaatctctgatggcaattcatgcattacaggacttagtatctgtgtaagtagatcatgtggaggaggcagagggataatttacccatctttcattaaactgccttggcatattacagcaggggccctaaacccttatttaagaactttaaaaaggattacattccaggaatcccccaatttccatcggcttgaatgctacagagatatgaaccacttaggctttccaacctcagctgcatccagtctaaaactactacagactgtaattcagcagcacatagtatctttccttgctttgttttggttggatttttttcaaatccgaaaatacgtgtagattcagaccaagtcataccacctgtcatgaggtgggtcaaacttctcaggttcttttctttctctcaaaatagaaatgtcttaggttctaatttagattgtcccaggttggatttctgttattgttattgaagaagatactgacctgagataacatcagtctctagctgggtctgaataagactcaacttggaggtgaggatccctaacacctgtcagctatagccttgagaaacattgttggacaaaaataagagctgaataatgccatttgcagccgcgtacttcacaggcggggcaaagcctctttgcccacagcaagctgagctggatgttgtgtcactttgttcaagataatgtgttgcaacctgaatcagaatacagattttaagttctgtaatataggcaatattcgccaaagactgttacaagaacagtacagatttttctattctggccaaattatataatagaattacctgcctctatccattagaatagcaggagagaaaaatgtgttttgtttttcagtatgagagagggagagagaaagttagtttatgtttcttaggagcagatattgagaccaagattttaatgtgatcacttttaggaagggatgtgagcctaggaaacatcagagggagaagagaagacaaaagaaggagctcggaaagggtgtgctgtcctataatacaagtgattgctgcgggcagttgtagcttcattctgaggagtgtctctgagaggtagagcagagcacacacctcagcattctcattcccaaaacaagagggagctggagctgctggtcaccaacacccttcagccattgctggaggccaatgtaggaggcattgtctcctggcatgtcctgtatgctttgtgctttgccggagctgaacctggtagccaggaaaggcccttgggcaagaagacacaggtgctgggaggtggaaaactggaagaccagagcagtgtccatgaaaattatacaaatcaagaagatatgggcaggatatctatacatctatatcatctacctctacaactataattgtatctatatctatgtctatatttctaactatgcatttgtatttatttatttattttttagatggagtgttgctgtgttgcccaggctgcagtggagtggcacaatcaattcactcctgcctctacttctcaggttcaagaaattctcctgcctcaacctcccgagtagctgggactacaggcgcatgccaccacgcccagctaatttatgtatctttttagtagagtgggagtttcaccatgttggccaggctggtctcaaactcctgacctcaaatgatcctcctgcctcagcctcccaaagtgctaggattacaggcatgagccactgtgcccgacctgcatttgtatttatggatacatgtttgtgtgcatgtatttatacacatgctggctgtgacttaaccaaaacaaaatcctataaagtaaaatgtccagattttacaaaacactttcataaacaatgaaagcttggtatcaacaatacaaaatgacctcaaaaacccaatcatttgtaaattgagtgatctacttgtaaatttaataaaaacatggtattaaacaatattcagatcaaagggaacatcataacagatatgtcagttatctaggaagtaatgaaaaggctaattctgtatgccaaaatctatgataaacctgtttatattcacaagctttcattattaaaatgaaaaaaggctgaacataaatgaaataattattcaatataagaaactagaaaaaacaattaaaatagtaaaataaaagagaataaagataaaaacggaaattactaaaatagtataaatagtagccaacagaaatatatccaaacatcatttctctgaaaataactataaaacagaaaaagtactagcatattagattgagaaaaaataagatggcacaaagaaatgaatgagattatgaataaaaaggcaataaaatcacagatttaagagattaaaagaaacattataagtgccggccgacaccccgtctgggaggtaaggagcgcctctgcctggccgccccgtctgggaggtggggagcgcctctgcccggccaccccgtctaggaagtgagtgcctctgcccggccgccccgtctgggaagtgaggagcacctctgccccgccgccccgtctgggaggtgtacccaacagctccgaagagacagcgaccatcgagaatgggccatgatgacgatggcggttttgtcgaaaagaaaagggggaaatgtggggaaaagaaagagagaacagattgttactgtgtctatatagaaagaagtagacataggagactccattttgttctgtactaagaaaaattcttctgccttgggatgctgttaatctataaccttacccccaaccccgtgctctctgaaacatgtgctgtgtccactcagggttaaatggattaagggcagtgcaagatgtgctttgttaaacagatgcttgaaggcagcatgctccttaagagtcatcaccactccctaatctcaagtacccagggacacaaacactgcggaaggccccagggtcctctgcctaggaaaaccagagacctttgttcacttgtttatctgctgaccttctctccactattatcctatgaccctgccacatcaccctctccgagaaacacccaagaatgatcaataaatactaaaaaaaaaaaaaaaaaaaaaagaaagattataagtgcatagtctatgtacttctatggcaataaatatgagaattctgaagcgagtggctagtttcttgcaaaaatattctaactggcttcccaaagaggcagaaaactgaatctacaaataaaggaaggtgttgaaaaggtaattaaagagacgccaggttaaaaaataatatacatcagacccagatggtttcacagttgtgttctacttgagctttaaagaacaaatcatttctatgtaacataaacttttctaggctaaagaaaaagctggaaaattgcccgatttcatgatgttagtgtaacttttaagctataacttgctaagatgagtggaaaatagtggaaaaaattgtaggataattctatatgcttattgtgcatgattaggtgcaaacattctaaattacaactcgatagattctactatattcaagataatgaccaatatttttaatattggatgaaagcatgaatgaatggcttaagatcatttattttattaaattaaaggagaaaaccatctgtttatattcatgggaggtgatgatggaaaggcatttggtaaattgcctaaaaatgtgaggctattcctaaaaaatctctaggtaagataagagtagaagaacatgaccattacttaacagcaaatatcattggaaagaaaaaagcaattatatatttcttttaaaaatcaagggaaaaatacagaatgaacaccagtaccactcttacttaacatggctttgaagattcttgataaaccagaaagctaaagcaattgttaaattattaacatatattttaaagctacaacaatgtttagtttgcagatgttgacactaaatatctagaaaattgaaaaaacaattaaaggtacttaagaattagtgaggcagagtagtaaaatgaatgataaaagctgtatatgtcaaaattgtcttgcattttatgccaatagaataaattttaaaattagattatatttttattcataatagcagctaaaactacagaataactaataaaatagattttaatatacatagattatatacacacctatatatgttttttcttttcttagtcaatcgtgtttgtgtgtgtataaacatatatttccaggaactttgtgctcacagtgaaggacaaagccacatcctgaatgaatgaagaaatataaaatattccttgttgggggggatgagaaacagtcatgtaacctattaatttaatacaattccaagcaaaatcttttgatacaaagaatgtaatgaaagagagcaacatgaatactctgtctcacttcccaggtcaatgttaacatagctagaaaatggaaaagtgcttaccttgctggtgttcagtaagcaaaatgtaaccctttcttatttccctcgttcccacacctagacgaccatggggccacgacagagaagcaagagggtgcattgcactgagaacaagcagcttgtcctctttctcccagaatagctcaccaggactgaactatttctacttaaaatattatacttctgggaagttgatagataagcatggaatgtcgagaaaactaaggcaactgaccatgtgtctcaaagagggcagccccataaacttctgcgaggcattattaagatgctctcactcttgttgctgcttttatacactactcttctgtgtttatagctgcaacgtcaatgggcaggcgaatttctacttctcttgtccagttgctagaggaaagcagaaagttgcacacataactgatggttgagtcagtccatgaaactccagacatcattccccggggttatgtggaggttagtcagactgcaaccctttttcattgtctttccttaatcctcatgaaaagttgcacttttcttttgtcgttagagctgatttagaaattgtaatttatgtttcattaatattcatttttgtcaacatgattattgttttttaaggaaatatttattgcatctacttattatttggcattgaccatgagatgatgtgattcgggaaaccttgataataaattttccctctggaattgcaaactctatccttctcactctgaactgcagtttctctcaattctttgcaatttcatgcatcccaaggaggtgaaaaatactcctctcttactggagataactttaaattaaatccctgatctgttacattttctgtgacaaaagggctttcttaagatattattctggattttgtacatcagcaaagcctgttgtttccagcctgttagtgtgatatatcaaaaatgcacacagacatataaatttctgatcaattattttgaaaactctaacccatatgaaactttaaccaatgtccatatttttaagttactatttttaatagccacacaataattccttcttcctgaaatattccatagacataatgtaaccctaggaaacccagttgccctttgcatggctgtggagaacttctcaatacttgattgtttcacataagggaaattagatttttaataaaaagatcacagttatctttgccagacagttaaatacctgcatgaagtactcattgaaaatatacttttttaatacaatgttttaaaggtatacccatgaagctaaaaagactgcaagaaacagaagccaaaaagactgcaagaaacactgcaaagcaaataccagctctgacagatgtcacgtggcatctgctgaaacacgaatggaggttttattaatgttcaactgtattgtgtacaatagcaacagctgattagcgatgggagtggaagattctgacttcactcttccccatcactgtttctctagctgctaattaaaatatctcagaaattttagacatctttttataactcattgtaatatttgttctccctcaaatctactccatacaattccatatgccttttctgacttacataattctgctttgacataaatgattaatacagtttgagatgaaaaagaatacaagtgtaaataaaaaactccctaatactgcgaaattttattttatttttatttttattgtatttttgagacacagcttcactctgtcgcccatgctggagcacagtggtgcaatcgaggctcactgcaacctccatctcccaggctgaagagattctcttgcctaagcctcccaagtaactgggactacaggcacgtgacacaccatgcatggctaatttttgtattatcagagatgaggttttgccatgttggccaggcttgtcttgaactcctgacctgaagtgatctgcccaccttggcctccccaagtcctgggattagaggtgtgagtctccatgcccatccataatgcaaaatttgaaaatgcctttgttttgtattaaaacctagttgtccaaaagatttcaaataaactatatatttgcacaaaggatcacagttatactttgattccttaaaaaaagggaaaataaccatgcttagaaaatgcatccacacttttcacacagcaaatgtactaaaagatcttcatttgattaaatattttttcatgtttgaatggaaaccacaagatctgtataacagacatgttcttagagtctaagaatgcttccttgataccagccagtttcagctgacatctagcaattctagtattcatgtgaacttgctataacaacatcaggatacttcataaagcaattgttgaaaaaaaaaagtcaaactctgtaaaatatttgaagagatttatcctgagccaaatatgagcaatcagtgtcccatgacacagccctcaggaggtcctgagaacatgtgcccaaggtggtcaacttggttttgtacaacaaggctacaacttggttttgtacattttagggagacataagacattaatcataacataacataacataagatatatacatcttatatgtatattggtacattggctcagtctggaaaggcaagacaactagaatgttggggggcttccaggtcataggcagattcaaaaatgcactgattggcaattggttgaaagagttactaactaaagacctggaatcaatagaaaggaatgtctgagttaagataacgggctacgggctacggagactgatgttttatcatgcagttgaagcctccaggtagcaggcttcagagagaatagattgtaaatgtttcacaacagacttaaaagagtctgttctatcagtcttaaggtcagctgtgtctgaattgtagaagggaagagggaataatgaagcatgtccaactcccccttcttatcattgcttgaactagttttccaggtaaattttggaatttcctgggccatgaactggggtccattcagatggttgaggggcttaaatttttatttttggtttacactatattgtagccaggtatgctggctcattcctttaatcccagcactttgggatgctgaggcaggaggatcacttgaggccaggggtcaagaccagcctgggcaacatggtgagacttccgtctctacaaaaatattcgaaaattaggcaagcacagtggcacgtacctgtagccccagctacttgggaagctaaggtgggaggattgcttgagcccagaagtttgaggctgcagtgatctatgattatatcacttcactccaatcagggcaagacagcgagaccctgtcaaaaaaaaaaaaaagaaagaagaagaaagaaaataatgaaagaataaagaaaaagaaagaaagaaagaaacaaagaaagaaaaagaaagaaagaaagaaaggaaaagaaaagaaaaagaaagctgtattgcctcggagcttatatgttaataagttttatgttctgaaaataaaaaaaaaccatcccaaaagttatgcctgccaaaatcaggattaaaaagatcctgaagaaagacatctcactttgctaatatgtgcagagtttgcattttattagttctatttcattcattaacttggttaatcagtgatttatggttggccaatgatttcaagatgagatgaaatttattaaagtcatgaaaaggcaagccatcaaacttcaagggacttccaaccacacagcccctgaacattgtcttgatcgcttggtgttgcaaatgcccttttggtggagcttaaataagatcagttggactgagaaagattgcttgatgtagagccattgaaacaagctgagtgtcttccaaggcagggacatccaatccatctcagatgataaccttttgcaaggcaggatgtccagtccatctcagatgataacccttcaggcatccgtcctggtgagcattgtttacccttcccctgtggtcacagtgcaagctaatactgctagctgcaaagctccataaaggttgttgtaatgcagagactcccaggaattgagggatgagatgaaagtgggttctgcataatggcccgggcagtaatgctgttgtaagaaactccaccaaacttcaggaggagaacagagccaatgttcagcgaccttcttccacaaaagatggtgaaaagtcttttttttgtttgttttttttctttttcatgctacaaattcactttgcattcaatttcaacctctgtgtttgttggatatctcttgtctacatctatggttatttccaaaataaaaagtaacatgtttaaacaataaggcactttcaaggaaaaactgatttatttctactaaataaaaattgttcccagtaacaaccatacctaaagaagttataaatctgtctttaattttgcaatgacaaatgaaaaatgttgactttttcaatcaaacaggtaattaagattgtttactgttgttggttgtgttaaacaatgaatgcaaaaaatagtttgctgtaatatacagataacacttaaataaatgtgccattaatggagaaaagatgactttttcccaggaccaacgtcttgccctcttcatttccatctgatgttgttcaaaacagtccactagcaaatacagttgttttgttggtggtggtggtttttagagactgcccgtgcatatataccagttactatatggacagttaaaaaaaatagggagagagaaatcaatacttgtcattcaaaataagctctcattatattctccagtagcgtatctcttgttctttcactgcatttcataagccttcctgcatgaccatcttcacattggtgtaattcttgctctctgtttttcctcctcttctggctttcctgggccacagtgagaatcagcatcttcagtatggattaatgcctgtggccctgattccatcaggaggcatagtgagaactgcaggaaaggccagtggtctctctcatttggaattattttttaggtcccctgcaatagtcactaagaaatctatctctttagcaggcactccataatagtgcagaatagaagagtttaaaaaaaagaaaagaaaagaaaaggaggaaaagatgagtgaggatccaaagctttctgaacaggacattagtttttgctgccatgcagtgtccaggagacagctaaatgttacagcaggaccaacctcagcccaaacctggttccattccttagggcaggtctggtgtctgccatcctgaaggtcggaacaccccatctggattaagtaagatttcaggcaaaattattttatctccttataaatcattgagtcattcaacatttatttattcgttagttcatgaatctgacatttctgaaatgcttatttccttggagaaaaggctggagaattgcataaaaaacagatacactgccctagataattctcagctctgtatactggagtttggataccccgtggaaatggaaatgctactgagagatatttcccttcctaaagaagtatctcctcacacaggcctcacctatccacaaagtgagctggaaaatgctcaagagttgtttttatcacctcctggaggtaattccataggcagtactaacctggctgtactctagtgattgttgtctcatttgatggtcttcaatgtagagtgaggtttataagaaaacaaattagatgtaagaagatagttctggaacttccactcatatttatttctacctaaatagttaagggagtgattaagacatgctatgctgatttgtaacagttggcttgacgttgactgcccacttggtactatgacagtcacgatgcataattttcttgaaattcgaagcaccctaagggcacacttgtagtctgtgaaccacagagcagccttgactgggcttttaatttgcttagccctcaactttcagtgtcctgtgacatatgcatagttaggcagatttgtgcattatttcatctaggtttaactgatcttgcccacacaaaatgaatatgtagcttacaattttcctgggaaagaactatggattcaaaatatttgtccatatttcaagtccaagagagaaagataatagctcagttgattcttggatttaattctaataggagattttcactatccatagtatgaggtgaacacagcacccatgtaataagatgggccgagcaattgcctgcggaatctgaagttatcaagagcattatttgaaatggaaatttgcatcaatgattgttagccatgaaccttatccctcgagatcatctcaaactgtattattaagccatcataattagcaagacaattagaagtcagccctcctggacaatatcaatgctaatatatatttttaatgaaaacaaaagggaatatgtaccatttgtaaataaaaatatatgaagtaatatttccacattataatttcatctcttaacctcatctttttttctacttctgtgttggttttacagtgtaaattatatgtgagtacagtaatgcatacctatactttgtaaagtaagaaatgccaaccaattgagaatgaatgccttaaacatttctactgatgggagtaaatgaacaaaaactttggagtccaaggatctgcttgctgggaaacagtctgggcagagaaggccacctcccttagtgttgcaggcaacattgcgctccgccagtcctgctctgtgaagctactgtagtttgcttcaagagagctctttttggtttttctgtaaaggaatgtagaagccaagaaattcccgcagatgaaccaaaataattattaacatcctgtaccaagattttccaaaatccccaaaataattccctctaatggtgtcataagtgttaccaatgctaggaatgcatcctattagacaggaaaactaatctgagcataatgttgcatcctcttgtaataaaattaggctttagataccttaagaaccttcacccacatctatccggcctcatttgaaaatgggaaggtgctgaaaaaatggttagaaagacaatctctatttttcaggtatttaattaaattattcaaccgaaaatagaaatagaaacaggaactccctttgtccaatcttagatctctccctctgttcccactgcagcaatcccaattccattacataatacacacatctgccccatacagagccacctaaatttgacctttacactcattccaatgcctgggaatcagaatgcatccattcttgaagcaaaaagcaatgaacagccgggtgcggtggctcacgcctataatcccagcactttgggaagccaaggcaggcggatcatgaggttaggagtttgagaccagcctggccaatatggtgaaaccccatctctactaaaaatacaaaaaaaaaaaaaaaaaaaaagtagtcgggcacggtggtgcatgcctgtaatcccagctactcaggaggctgaggcagaagaatcactttaacctgggaggtggaagttgcagtgagccgagatcatgccactgcactccagcctgggcgacagagtgagactctgtcaaaaaaaaaaaaaaaaaagcaatgaccaatgaccagcatctctttttatgcaccttggtctttgctacaggacctaagtaataaaagcagaaagcctctccccatagtctcactatccctttttaaaaataagaatctttgggaaacttcaagaggacattgcattggggttggaaattggaaagcaatgaagaactgtgaggcttcagttgtgttcagtcttgcaccagtgaggagagatgggcctgaagctccccatggaaaacctgtgaggttttctaacaactatggaagcgcccaaaacaaagatgacaccaagggttatactgctgggaattccatttcccaggctctccagcgctcccctcttatgggccagccggtctcctaaccactatttataaggatgcggtacagagaattgtaactggcagacctatagacagacactggtgagctatcatttgaaagtgtacaataatcacttacattagtaattcaatagctcaatcataatacttcaatgcactgtttttcagttgcaaatcaaaacaaaatcatcattactggctaataataggttattctgttgattaaacaaacttggattgttttgttggttaatagacatgggcatctcaccacccacacctcatgtaatattttctaaacaatatctaattaaaagatcacatgaacaaaatgtcttgtatctaacaccatgattggtctgttacaaaaatatgcatgagacaaggaaagacataaaactctgcaagttgttttcaaggttttattttaaaacaaaaacaaacgaaacctttactcttgcttccattgtcaaattgttgttgttttctttttctttttcttttttttttttttctgcacattggaatgttttccactgggggtgataatgcagcacagccatatttggtatgtctgagggatgtgtctgacttttgtgaaatacaagaagagtaattttgataagtgaagtagaaaagtagatgaagaatgatgtctacaacatgttgcatgtttcaataaagaatgtttttcatcctggagaaacacctgcgctccagattgacaattgccaactttgatactcacacccagaggcaacttggctttatgttaaagaccacactctgaagtcaccgtgcagctttgtcacttgtcggctggaggagctcagagaagcactcagcctctccatgcctcttgcttgtctgtaaaacaagaatgatgctaagacttactacatgcagtgttacggggattaaatgatgatgcatttaaaagaatcactttagcccaatgtccgccacattaaaaaccacaaggaattgttgcaggaagtcagggaccccaaacggagggaccagctgaagccatggcagaagaacatggatggtgaagatttcatggacatttattagttccccaaattaatacttttataatttctcatgcctgtctttactgcaatctctaaacataaattgtgaagatttcatggacacttatcacttccccagtcaatacccttgtgatttcctaggcctgtctttactttaatctcttaatcctgtcatctcataagccgaggaggatgtatgtggcctcaggaccatgtgataattgcgttaactgcacaaattgtagagcatgtgtgtttaaacaatatgaaatctgggcaccttgaaaaaagaacaggataacagcaattgttcagggaataagagagataaccttaaacactgaccgccagtgagccgggcggaacagagccatatttctcttctttcaaaagcaaatgggagaaatatcactgaattctttttctcagcaaggaacatccctgggaaagagaatatgtgcctgggggtaggtctatagacggctctctgggcgtggtcatcttttatggtctgtagactgtaggggtaaaatagatcccagtctcccatagcactcccaggcttattaggaagaaaaaattcccacctaataaattttggtcagaccggttgctctcaaaaccctgtctcctgataagatgttatcaatgacaatggtgcccaaaacttcattagcaattttaatttcgccccgtcctgtggtcctgtgatctcgccctgcctccatttgccttgtgatattctattaccttgtgaagtacgtaatctctgtgacccacacctattcgcacagtccctccccttttgaaagtccctaataaaaccttgctggttttacggcttgtggggcatcacagaacctaccaacatgtgatgtctcccccggacgcccagctttaaaatttctctcttttgtactctgtccctttatttctcaaaccggccgatgcttagggaaaacagaaaagaacctatgtgactattggggcaggttccccaataaggaatattagctcttgtttgtgttaggattgctgtcattaatattatgatcctgtaaggtatcaacaagaacattggatacacacagagacactattaattagaatttgttgtttgaaagaaggcatttcccagagcaactttggggaattagacataagcatgggtcttctggcacctagatacttttttgttctgtgcaggaggagtcagtatgagttaaagaaagctatccattatttaggatgaaaccaatgtacaagtgcagacttatgataatagtgagttaaggttgcaaatggaattcaagttgctaatgagctgactttacagtagggaaattattccagagtatttgggtgggcccattgtaatcacaaaatgccttaaaagtggaagagggaggcaggagggaagatcagaatgattcagtataagaaggactcaacctgtcaagttggcttggaagatggaggaggctccttgagccaaggagagcaggtcgcctctacaggctgggaaaatcaaagaaatggaatttccccttaagcctccaaagggagagcagccctgccgggtgagtttgtcagactgtgttcagaaatgtaagatcataaaattgtgttgtattaactcactgttagtggtcatttgttactgcagtgttagggaacagatattagcactcgtgatgtaattaaaatcattgtctttgctgcatgtggtaatgaagctgcaaatgacgtagatcaccttgggctccctcctttaaagttctcacccatcagacagtacacactactcctgggttttgtcatagctatttgtatgtatcacctacgagccccatatccagtcttggtaagtcaaggactatatcttttcagacagtatctcaccccaccatttattaaaagtattgaacggccactatgaagaacagtatggaggttcttcaaaaaactaaaaatacaactaccatatgatccagcaatcccactgttgtgaatatatgcaaaagaaaggaaatcagtatgttgaggagatgtttgcactctgaagtttattgcaacactactcatgatagccaagataaggaagcagcctaagtgtgcatcagtagatgaatggataaagaaaatgtgatacctataggccgggcgtggtggctcatgcctgtaatcccagcactttggcaggccaaggcaggtggatcatgaggtcactaaaaatacaaaaaaaattagccgggcatggtggccggtgcctgtagtctcagctactagggaagctgaggcaggagaatggcatgaacccgggaggcggagcttgcagtgagccgagatcgcgccactgcactccagactgggtgacatagcgagactccatctaaaaaaaaaaagtgatacctatacacaatggagtactattcagcctttaaaaagagtgagatcctgtcatttgcaacaatgtggatgaaactgaaggtcactatattaagtgaaataagccaggcacagaaagacaagcttctcatgttctgacttatttgttggagctaaaaattaagacaattgaactcatggagatagagagtagaaggatcgttaccagaagctaggaagggtagttggggggtgtgaggggagtgaggatgttcaataggtacaaaaaatagtttaaaagaatgaataacatctagtatttaatagcacaacagggtgactatagtcaataataatttaattgtacattttaaaataactaaaagagtataattggattgtttgtaacacaagggataaatgcttgagaggatgaatgccccgttttacataatatgattattacacattgcatgcctgtatcaaaacctcttatgtaccccataaatatatacacctatgatgtacccacaaaaattaaaaattaacaaaaaagaatgagatcctatcatttacaacaacatggatggaacttgaggacatttacattaagtgaaataagccaggcacagaaagacaaattttgcatgttctcactcacatgtagaagctaaaaattaaaacaatggaactcctaaagatagggagtagaaggatggttagcaaaggctgggaaggggagtgggtgtggagggtggggataatttggaatgattaatgggtgcaaaagacagaaggaataagatagaaggaataagagctagtatttgataccacaacagggtgactatgtcaacaataattccttgtatatttttaaataactaagagagaggaattgcaatattcctaacacaaagaaaggattaatgcttgaggcgatgggtgcccagattaccctggtttgattgttacacattgcatgctcatatcaaaacatcacatgtaccccataaacatattcacctatgatgttcccataacaattaaaaatttaaaaaaataaaataatttaagtatcaaatatgaacacaattttatgtctccctttttaaaaacttttgtgtgctctctccttttttgagctagctttttcttcctgcattgatattctacccatgaccctgcaattctactattctaaatcatatttctctgctatccacagccttttctggaattgacttactactcaattctggataacactattagtgagcaaaatgaagtgaaggaaagttttcaatgaccaacattaatgtggctgaaacgggttcagagaatctgctcagatccttgtcaaatcccgggaaaatctcacagacctgggttccccagcactggcctcaaattcctcaggctttctgggcttattgaatcaagggcattggttgtccttgaataaagtgtatagcatgtcaactaccaaatattttgctgcagtccagaaaaatgaaaagagaaagggagaagtagctgcaaaaatcctctacaatgccattcttggcatagaaaaatctagaagagcatgaagatgttagggggtggcgaatatccaaactattgatgggtctgatgtgttaaaataaaaacttcagccaaattaaatttaaaggagtttaattgagcaatgaacgagtcttcagagatgccttgtggtcagaaccaatttataggcaaaaaagggaagcaacgtacagaaatcagaagtgagatacaaaaataactggattggttacagctcggtgtttgccttatttgaacacagtttgagcacttaacagtctgtaagtggttgaagtatggccactgggattggccaagactcacttattgttacaggtcggtactcctaagttaggttttcaatcttgtcgacctactaagttaggttgcagttcatccacaaggactgaaatatagaagtaccaagtccttctcaggtcatatttagtttgctttaacagtggcaacctcaattcttgcctcctcaaaagaaagaagaaattcaactgaggggcataaggcagaaaaagagactgaggcaagtttcagagaaggagtggaagtttattaaaaagctttagagcaggaaagaaagaaaagcacacttagaagagatccaagtgggtgacctgaaggacaagtgccccatttaaccttgactctaggactttatttgctggcctgtttctggcatcttgcaccccttttccctcattcttccttaagggtgagccacgcacatacttgccttgggaggtgagcatgtgcagtgtgtttaggaagttgtgggcatgcccacctgaggctttcttcccttttccagtggaatgcccccagaaggtcatattctgccattttgtctcctaaggagaatgcccaaactcactcccaactcctgagattttattggaagctgcagattaccaatctcaactgtttggtaaattgcctatccctggggcctgcgatcaattatcactttagtgtgacaactgtgaattatcaggaaatggtctctccatggcggggcgctggctgccaattatcattttaagagaggcattgtgatcactgcccaaccatcacctgatggttgcctgacattcctgatgggaagcactctcccgccacactcatgcctggataactacctgtagcaaaattgttgagaacattcattcttaagaaagttaagagggagtccatacaaattataaatggagtgatacattagacactaatggagacacatggactctgacttcctaaaagtgtcacttggggaattattataggattggatgccaagctctatttccagatttacccccatggccctgagtgccagctgaatttttagtaagctaggccttcaggataaatatgcattagtcattccacctacgatacccggccagtcaaccactcatcaataagcatggtggtgaggactgaactttgaccttttttcgtcttttgcccaaattcctatctaaggggcctaaagagtccaccctacaaaccataacgtctcatcagaggggttttgtttaatcctatataacatggcctgctttccagcctgactctgacatagcatcgcatgacagataagaaaggaaatccaagtattttaaccccaaatgtgtttatttgccatatcttgaaatagccatgcgaagttgtctcctggggaagatctacattctatagagaatccctttcccttttcaaggtctttcttctgatccaggagagaatcaactaagaagttgacacctttctaagtctgataagaaacatttactaacatttacaatctactctctctgatgcctgctacctggaggcttcatctgcatagtaggaaccttggtctccaaaaccccttctctctctctctctctttttttttttttttgacaaaggttctcagtctgttgctcaggctagagtgcagtggtgcaatcatagctcactgcagcctcttatcttaacccagacatttcctttctattgattccaggtctttagacaaactcttttaaccaattgccagtcagaaaatctttgcatctgcctataacctggacccacccctagccctccacttccggttgtcccacctttccaaatggaaacaatgtacatcttacatggattgatttatgtcttatgtccccctaaaatgcataaaacctagttgtatagttgtggcctgaccaccttgggcacgtgttctcagggtctccggagggctgtgtcatagaccttggtcactcatatttggttcagattaaatttcttcaaatattttacagagctggactcttttcatcaacagtggtcggccctaagtgcatccctaggttggcaaagctttgcttatgggctcagataagtctcctcccttatggcagaagtgagaggaaggtcctctcccagccccaaagctcaggctttgtttcctgtgactaaagcctcccagcccaaggatcctggacacacatcaagagagctcccttggagccgagtcctaaatgtcctattgggggttgggggggagaaaagacaataaccctacaacaaaaaacaagcctagcaaatgatttcttaagccagtaaaaaactcatgcgaaagactctgtacagactcaacagagatttccaggacgtcatccatctccctaaaatacgcatttcaagttctccattgtgtttttggtactgtaaaatgtatgttgatttaagctgttctcatgttacacagtggggttgcttttggcctctgtgagatgccaagcaccttggcaggactcagaatccactccctatgcgactcctcggtgtcttcttcacttggcataggtgctgtggttgtcagcaactgaatgaagctgatgttttggctttgggccttgctagagaaagctgacatctgtccaaatgacaatacagcacctgtaaaggaacagagatgaaggtacaaagacgtcgctatctgtacagtggtgaagcacccacacctgcactttggagacagctgtagggcttggatttgcaaatcctggcatgtgcacagaattgggctttgacttgggtgtggtaacacttctgttagaatgctaggggaaagtctctttgataatgtggggtggggcatgacaactcattggcatcttctctcaagcttggaaccagagtcgcaaaaccagatgttttggttgaaggaagtgtggtaagtggatttgataataaggaaggcatcaaaatgctttgcatggctggtatgggaatactggggtgccttttatcaactcttacctctaacccgactacctttgggaatactttagtagtaaataattattgtgttaaatcatgccatgtgattaatttggggaaacagaaaattatcttcatgtggaaaaacaataatagcatgtcttcaaactactcagtcaataaacatttcttatgttgagagtaattatatatatatatatttcacatttgagatagttcattcgataatcacttatttctatacaaaatgtggtaagaatattgggaaacatttgcccatgaataatacccacaacatgcctcttcaatttatagcctaatttgacttggcagacattttgcactcaaaagcgtgggattgagccaaatctaacctcaccacttttattttatcaaaacctggaatatttcatcatagcaaacctgtaaaaggggtttctttttaattatcttcttaaaacatttagcattacaaattcatcattcgattggctatttgcctggaagttatcacacatgggaaaaatgccaatatttgcaaaccccagggtggtgaatcactgcaaacaaaactgatgactatatagaataattgttgtcaagtctttgacaaagtcctgaaaagtgtgtctcctgatgttttcaaaatgtactctgaaattaaaaagtagggttaatgtcctttgtaaaatgaaaatgattataaattatcccattacctagagaaggaagagaggagagaaaaaggaatagcttttgtaaaagaacttcggggttagctatattcattaatatacatcagtggtcaaacctaaggagtcttgcaagaaagttaggcacagccaaatcgcaagtcttcagttctgcacagagagtctggacaactacacacggtagtgattgtctctccagccgcatattagaatcaattcaaaatctttcagaacatcccgctgttcagattctgatggaatcagtaaagtgtagctcaaaaaacaaaaacaaaacagaacaaaaaaacacctcgaacatatcaagtcacattgacatttaacttgctctccacctctacatagataatatatttagtatcctatacatttactatcatatacattccatatgtatatcaaatttcatacttatatgcatagtataccatacatatatacacagtatttatacatacatacaacatattttatgatatataatattctaatatatatagtatctcatgcatatatataatacatagtactctgcatataaatggtatttcatgcagtagtacagcgtatttcacacatatatagtctatgcatatatacagagtatttcatacacatatgcatatttacccatagatttaacaagctatgtagtatcttttgcaacttgcccttattggaggacagtctgacaggcagaaaagattagtggttaactacaaggacactggaactcaatggcctgggattattttcaggctctgccactcggtagctatatgactttgggcttttttttttttttttttttttcttatggagtctcgctctgtcacccagtctgcagtggtgcaatcttggctcactgcaacctccgcctcctgggttcaagaggttctcctgcctcagtttccctagtagctgggattacaggccatgccactatgcccagctaatttttgtatttttagtagagagggggtttcaccatgttggccaggctggtctcgaactcctgacctcaggtgatccgcctgcctcagccttccaaagggctgggattacaggcatgagccactgcgcccagcctgggctactggtttaaatgatctttgcctcactgtcctcagctttaaaatatggccagccatagggtggctgtagaaatgaatgaaggaatgtcaataatgcacttagtgtaccttacaattagtggttcctcagtaaatgttagctgtagaggttaattccattagtggtctctcaagtaaactacaaaaagctacaggcagggccttgtgaagcatcctgtgccataccgaggtggaccaccctacgaaggaatgtaagatgcttcctattattcataatgaagcccattgcatatgattggctgctgtttgagatggggaaggaaatataggggatgaaaaggtcaagtcggcatcagttttgtattgcatgatagtctggtgctataagtataatgactgatcaatgctaattggctgtctctgtgactgcccttaaatcactaccagctgccccttggaagctatttcacaaggctcagaaaagagaagtcgtttccactaataacactcgacagcatcccaaattacatttgcctagccctatattttatcagtatttctcaggataaattccaaattatactcaaaagaagatcgaaaggaagacgcctgtgatagctctacctatatttatctacatgtgtatgtatttgcatgcattttcatgtctgcatctacatctttatatgtaacttaatccagggaatttgaggagaaaaacttcagtatattctgatgcactgagataaaaatgtgatgcttcaatatgactttttgcttcttcagctctgcaagcaggaatgtttctaacatttatcattcaatagcttctcagggtctggaagagtggtttgcggcactgggcacatattagaatcacctggggaccctttaaactagcactaatgtgcaatgtccatacttctctcctgatctttaggtgccagaggacactggacttcttaaaagctcccctgggagttctaataggcagccagttttgaaagcctctgacccagggtcagaatcatgctaataatcagagtcaattgtgcaaaactcaatctttaagtattaccttaatctgaaactcgattattcttcctactttgggcaatctttagttttctagccaataaaggatttcactcttctttttcttttctcaaatccacgtctagactataaatgtgcaccaggatttctctcagtgaaatgatttttcaaatctatagatttttacgtactcaaacattttgtttccttggacaagatggatttttctaaacagacttgttatgtgctcggccactttatgaaaacaattcactgacagaaattgaagatggcatcacatgcatattgagtcgatcattcctagaatgttaaagttaaaatcagcacaaagtacattgcactcagccctagggaaatgtgcaaaaatctgccatacctccttaaaactaatttatttaagtcattgtgtgtcccttagatgtttatctacttaaaacacaatgactcatttgtgtaaacagattgcaaataatttgtgtgtaaaattgaatagaaccaagtacatacaaacacccacacacacagaactgtgtgtatatcaaatctatgagatctgaataaaggatatggtttgtatcaatgtcaatttcctggttgtgatactatactgtagttttgaaagatgtcgccattgtgggaaactaaatgaagggttcaggatagttcataatctctattatttcctacaattgcatgtgaatctacaattttctcaaaatacaaagtaaaaaaaaaaaaaagagagagagagagagagagggagagactcctttaaagaagattggcaaatgacatagggcttggatttgaatttaaatttcacaaaacacagggagccctggactccacattgttccttatcagttctagttctcccaactacttcaatttcatacatagaatatatgtaaaatttactcagtaacatttactctacagtgttcccatttcaaaatttgctgtggcacctaaatcagacctctggcccttagtcatgatgcaaaagaactgtagtcttcagtacttatgtctttggtttcacggtctctccttctctccccacccttatcttagtctttctttgccttactttctaaatgccctcttaattctattttgtttccattcttagattttgcttttccaaattcttcttactgtgttctgtgtagattagaaccttctattacacagatcttacataaactgctcactttcctcatcttattctaaatttcattctgtcactgccagggattgaatatcaagaagtgttggtacaaatacaaccaactcaattttctattagttgctctaaattgttttagggattacaaaccttccacccccacccccaccttagtgatttggcattttaatttttttatatgattaattcaattttctttttcttcttttaacttttattttaggctcaggggtacaattgcaagtttgttatatgggtaaactcttgtcatagaggtttgttgtacagattattccatcacccaggtactaagcctagtactcattagttattttttcctgatcctctccctcctcccaccttccaccctcaagtaggtcccagtatctgttgttcccttctttgtgttcatgtgttctcatcatttagctcccacttataagtgagaacatgtggtattggcttttctgttcctgtgttggtttcctaaggatgatggcttccagctccatctatgttcccgcaaaggagattatctttttccttttttgtggctgtatagtattccatggtgtgtatgtaccatattttctttatacagtctaccagtgatgagcatttaggttgattctatgttttttgtgattgtgaatagtgctgcaatgaacatttgcatgcatgtgtctttttggtagaatgatgtatatttctttgggtatatatccagtaatgagattgctgggtcaaatggtatttctgctttcagctctttgaggaattgccacactgctgttcacaatggttgaactaatttacacccccaccaacagtgtataagtattcccttttgtctgcaatcttgccagtacctgctatttttttctttttaatgaaatacccattctgcctggtgtgagatgatatttcattgtggttttgattcgcatttctctaatgatcagtgatattgggctttgttttatatgcttgttggccacatgtatgtcttcttttgaaaagtgtctgttcatgtcctttgcccaaattttaatgatatttttttcttgtatatgtgtttaagttccttatcggtgctggatgctggatgtaagacctttgttacatgcataagttgcaaatattttctcccattctctagtttgtctatttactctgttgacagtttcttttgctatgaagaagctcttaagtttaattagatcctatttgccaatttttgcttttgttatgattgcttttggtgtcttcaatctgacatttttagacacacacacacacacacacacacacacacacacgtggatttttccaagcactgttacatgaccatcttcacagtaaccatgaagtgagtggcaaaatccttactttgggtgggaataccaaggcagagaaaggataggcaggcacactctctgtgtttctgcacaagagagggcacaatttttatttttatttttttttagacaggttctcattctgtcatccaggctggagctcaatcatgtgatcatagctcactgcagccaatacctggtgagttcaagcgattctcctgcctcagccacccaagtcgctgggactacaggtgtgcactaccatgtccagctaattttccattttttttttgcagacatggagtctttttatgttgcccaggcggggaccaagtgatcctcccgcctcagccttccaaagtgctgggattgcaggtgtgagccatcatgcctggcctcttactcttttcaaaaatttttcttggccgggcgtggtggctcacgcctgtaatcccagcactttgggaggccgggagatcgagaccatcctggctaacacggtgaaaccccgtctctactaaaaatacaaaacattagccggacgtggtggcaggcacctgtagccccagctactcaggaggctgaggcaggagaatggcgtgaacctggtaggcggagcttgcagtgaaccgagatcgcgccactgcactccagcctgggcgacagagcgagactccgtctcaaaaaaaaaaaaaaaaaattttttttttcttgtatcccctacagctttttctcctttgataccatgctccatcaatgggtggtatatgtagaagttgtctccaatttacaacaaagctgtattctcaggactcatttgtgtaaaaaaatacctccccaatggaaacaatactaaaaatatttcttgggttttcggtccctgccaagacactccactggccctaagaacctgcttaccctgtggtgtagctcaagaagtaaaagaatgtgaaggaagttggattcttattgcagccttcaagcccgatctctgggtcagtagccccagcctctctgatctttgatgaagaatggaggttggagaccagtgtgaggtgcccaagctgtgcagctgattggctgggtgaagcctcagagaatgagtggataagaactcccaggaaaactcccaggaaattcaggcctcagggactggggagggtcaagcctggggccactggcatgggtgctcatgctgtagggtggcggcagcagccattgaaagaaatcaaaatatttcacccccaaataacccttctttgacatatttagagatggctgttcagagggcctgaaaataacagccctacaaagctgtcttttgtgggggaaattggcatctgtagatgtagagaaaatctgcattgatgcattgctgcagccaggctttctctgacacccactccctgcccccgtgtctggatctaggaaaaattaactaaaagcctaacacctttaaggtctgaaagaaacagtcaccatctattctctctaaaggctgcgacctgggaggtttcatctgcgtaacaagaccacctttgctagtcaggacttctcttctctccctcccataaattgtgttgccaagatccgagcccccattctttctgtaacttcaagatggcataaaagcgtcaagcaatcctccactgatagccttgataggctgtttccatacctctactattgtgaatagtgctgtgataaacatgtatctttttcatataatgattactttttctctgggtagatacccagtagtgggactgctaggtcaaatggtagttctatttttagtgctttgagaaatctccatactgttttacatagaggtcatgttaatttacattatgaccaacagcatataagtggtccctatgtacataatggagtattattcagccataaacaagaatgcaatcatgtcttttgcagcaacatggatggaatggaggccattatcttaattgaaatgacgctgacacaaaaagacaaatgccacatattctcatttataattgggaactaaataatgtgtacacatgtacatagaatgtagaataattgacaataaacacttggaaaggtgggagggtcagagggtgggagagtgggagtaaagagaaattacttaatgggtacaatatatattattttggtgaatgccctaaaagcctttatttcttatgcttttttttcttaggcattttttccaattcatcagcaattatgggtcaattgcatgtcaaagtggggatgtacaagcctctcaaaactctacttagataatggagatttaaaggcttatagtatagtacgtagtattgaaaaacaattgagtagtattgaaatacaggtgaatgcttattggcattgcatatatctacaattttaggagtaaatattggtggcaaaagaaaaacagcttaaaattgtatatccttgacttaatataccactaaaaccatcaggagttacaattgtaaacatgatgatagaaatctgaagtgttggttgtcaaactccaagatactttcattaggatgaagtgctgtcttgttaacatttaccagacctcaaattccattaacactgacatggaaagagactttttgaatctccttggcagcaggaactgtccatttttcctcttaaattcaataaagtttcttttcttttttttaagtttggagacagggccttgctatgttgcccaggctggtctcaaacattcaggactcaagtgatccttcagattcagcctcccgagtagctgagactacaggtgcatgccactgtgcccagcaaaaatgtttctttaagaaataaatgagtcgactccttggtctggtttaaggatactttattattgaaccagtatgtacaaactctaacatgaaaataatgagtcacagaatatcaagactatttacaatacttttttgttttttacaaaacatttttacaagattacttctctctaaataatgtgacagacatacacaaaaatccaactttttttattacatacataaataaatattgactttaaatgaccactgtaagggacatgaattctacagaccacttggatgagaaggtagcagttttgttatctgcacactacaatataattaagtaaaggggaaaagtaactttatatagacctctgttaatcactccgtaaatcatataactcactagaatattcagtagaggtaagacagtcatgagaatcctctccgtacctgacaccgagtctgaccatgcaaaatcacaggtaagagtcaacatctttatatatctgtttatattttataataaactttaaagtacatgcaacagatatttagccattgtgttctgcctataatatgaaagtttatataataagttttagagttatttgcaaccatagaaatgagtaaacttgaaaacccacggcataagaaagggcattaaataaataagtcaaaatcacaaatgacatttacggatacatagggcaaaattagtatttgtacttgtatgatacagacacgagtcaaaattccgtcttttaatcaagttgtttagtggacataaaaaacacagtttaggcctttgaagtcaaccataataacttcttagctgtcccttagtttttgggacttgctctagaaattcactgggtttcttataaagggcaaattcagtaaagatcattctctagcaatggttctcaaccagaggtaccatccctcaaggggtagctggcaatatctggagacatttttggttgtctcaacttgggggagggtgcaactggcatctggtgaggagaaagtgtggatgctactaaaaacctacagtgcacaagacaaacccccacaacagagaactatccagccccaaaagtcaatagtgttgaggttgagatgaacctctgtatacagtcggctatgtatctaaggttttcaggacacagatgtatttctaatctttgaacttcgtttaatacacattacaaaaaattacctgccataaaccttatcttctctaccatgtcatattaaaacagtgaatgactgaaaagagcacatgttggtttgcaaacatcattctatggagttccaggtagaaaaacagggtaacacagataaattcatcattaaggagcaaatgttgtaaataaaaataatgcatgtaactgcaatgtatgtcagattaaccacctgtatttgatgacaatatttttgatgagctcaattttttaaacagtcaatactattactggatatatttttctcacattagagaaatgaatctaatttcaataaaacatattacagaattaggcaccaaaactatgtttgttaaaaagcatagattttattctttattagagcaatcacatttttaaaattcaaaaaattataactatatttttgatcatttgaataatactggagcttattaaaatccataagagaaacacatgttttttattagcccattaatagcatttttcttccaataacaccaataaaatttaaattatttatttatattaaaattagaagcccataagagctgctttagatttttttaagggagatgtaagcttcagaatcaccatctgaactaaaaatatctgtccaatgtctattacccagacaaaagaagcatgattaaattttataaaattaaatttatgtaataatttaataatattttgtatctatgcagagactcccagcatttttaactatgcaacagtacaaaaatttgctggcataaacatttgaatttgttcatgacaagttcatgtaaaagataaatggatagctaataatgaaaaattttaatttttgaaattttaagaacttgaaattcagatgctggtaatgacaccagaataaaaaagagaagctatctatggtatccatttattcaagcttagggatgttttcaaatgaagattgttttctatttttgccactcaaaaattcttagaaccaggtaatttcataactcaatgtgataaatccatcccagcttgtgacaggagctgcagtgaaccattcagaaccaacatgaactttcattctgaggtgtccaatttatgttacttgtacaaagctgcaaaacattcctggaatatccactttttaaatattttaacacacaggaaatgggtttcaatatctattatcaggtatccatgtttataaatgtgtttcccaaagacatgcatcaacatcagaaaagttattttccctgcattttaatttgcatctacctttagacactgcagtgaggctctgtggagtacagtgacttctgagttatccactcttcccaggaatggccaggcatctgcatgaattcaggaaacaataaaacaacaagaagcaagtaccattgtcaaaacctaaggataatgttactgattttcttcctgttttacttaggtaggtaaagacatatggacacctttcttttacagtgtttaattttgataaattgctcttttctcagaatcagcattgatggggaaaatatattatccttatgacctttaaaagagctgtatctttactcaccattggtgagctacgaaaacgatttctccagggattcatgctcaaggtatattcatgtatatgcatgtgtctgtgtgtatatacatgtatatgtacatatatttgcatatatatacacatgcatttataattatatagacatgcatatctatgcacatttcaaaccatgtatgtgagtattccttcaagaaaaaaaacagtattaaattaaacttctctgcgttttaggttgttacaatatacactgcaacactctatattgataacacgttttgacttaagttcatgctacaaggcactaatttgtagcataaaacatttccaaaaagtaagatatactagatttgaaagcatatgggtgaattaaatgcaaataactgtccttctctatcaatcaaaggaatttttaaaacattaccaataatattctagcacacaaagacctttctttgattaagaaaaggcaaatctctgcaaagatttaaacatgctcaatagttgggattttttcatttgaagcaagaagttttgtgaattttcagatggtgaaacaaaagtgcaccaaaagctattatctgcattgaggaaaataagggaaaatataaataagataacatatcaggaaaatctctcacataataggatcaaatattaaaaggcatccccaagaaataattttcatttctccaaggtaaaatctgattagcagcttatttcattgagttcctctggcttgggtgtcttttgtaaatcataatttatagagggaactttgatttacctttgcataaagagcagcacaaggtacttaaagtaggagcatttttagatttaaattcgctggtatattttagattacacattttcatttaaaaatcacctaggataaaaatgatcttaggaaagattcaaaaaaacaaagctgtgtaatcttagttgatttttcatatcgaatcaataatttagtcaaaaatatattttattgattagatttacgcttagtgttatgtgtgaattgtgtatttgttactctcctttttggggcggagtttggtgctccaaattcagggaaaactgagttctgttgtaattcaatagaaatgagcgacaccatacatgaaaacaaaatttagcattaaacaggcctattcttcattttctccatgcttgtagggaactggtgtctgtcttcaccaatctactgtttctcacttgtctccagatgcgtccatgattgacagaagttcttcctgcactaaagtcacataggagagtccgggcctctgagcagttcccactgcctctggaagtgtgcatgtctcgtggccgaagttcaacaagcttacacatctgtgcaatttcacaaaatctttttgaacagtttagtatctttctggagaaggcttgtaatgatgtggatgacgatgcttaagatgagatcctaaaaagtgacaaaatatgtcagtcacatccatttgtatgtatcaaataaatgatagaattacctttatttgtagaaaaagcacgagaccctggcaaatgttccttcctatgaccatgtctttcctattctgaatctgaatgtacaaccacactctttctctccttttcctgtttttctcttcctctttgatgtcttcccaaactataaaataacaagaaaaagaagacaagctcctttccttaagctcacacttatccaatcaaaccataatccttttttatttgctcaaagaagtttaaaaattatcaaatacttctgttaaaaggaatttctatgaaggaatatcagaaaagcatttatctgacaaaaattttagaggctatcaagctctcccattgtgatagtttttgtttttcttcaaattataagcataccaagttatcaattataagcataccaatctatcatttaaaaaaatcagagttaaaactatgactaattctcaatgttttgtccacacactagtcatcagacacttttttaaaaaatttaagctagaaaataaagtaaacgaagtacataatttaaaaatcagcaagaggctgttttgaaaatctaggtgacaattttctttttaaattttacttgatttagcaataaatgaagtaggtggacttgggtcatatcatgaagaaaattcataatatttattacagtaatatctatgtaacaagaacataagttccttagcaaaatattatttcctatattgtgatatatgaaaatcttgatttaaaaatatttcagatatgagactacagatttttttcccatatgtatttatggtttaaaagacaaggaaaaaagcatgcattacataggggaaaatgcaaggaaggaaaaaaaaaacaaaggaaggatagaggaaaggagaaaagaagagagggaagaatgaaggagggagggagagaggatggagaaaggaaacaaggaaggagcaaagaaagggagaaaagcggggaagagggagggagggagaaaaagaacaattaagcatcaactatgcaatgtatactacaggtgcctggaatagaatctagtaagtcggtacaaacagggagaaagaatttcagatgatgacaatttccctatctcatagaaacctgtactagtgtatttatttgttttcattttccagcaagatttttctctatgtccacaagacctgacaggatggcttaatgccctggcaccccactcactgtgtgctgaagagggtgggagctccggcgtccggaacgtcttgatggtggccggcccctcccctcctggggtcagcacttgcacttccagtcggtaaagagtagatggtctcagattgggcactgttaggacataatgatcctaaggggacaacataaaagagcatgctcaccgacaacctttcagagacaacatgcaatgcacagagagcctagaacagtttttcccccactggagaatatcatacacaggcaagtttggttgctttgtaaaggcatagtttaatttatagactatttctcatttgtgggggttctctgccatatggtttcttagcacctcactcaattcttggcagcctaagacacttggcagagttaaaatatgctgaggtgccagttctcagggctcactcctgggattttatttatttttttaattccttaacgtaaaactttcccatggtttaaagtcttcagctgcacatcttgtgatgtgaactcttgatagtccaaatttcagtgaatgagccaactgtttttcttaaaacacagtatctgtcaatgcccataactgaaaatgtttatttttatgccaacatattcttctcaaaactcaataaaacctagtacatttatagaataactactctctaattccatggaatttttccttctgagatttaagttgtgtttctttccctctctgcccctctttttggattttgtaacggtagttggctattctaagggcattttcagagagggtaaaatcccacacatgattttttttttttttttttgaagccaaggaattaagtggcctggaagacaggccaactcattacagcctcgagccaaatttgaagttgcggggaagacggacaaacaacaagcttcttttagctattcctgccctccccaattcaacacttcaaacagggcatgttcacttggaccagagagacatgaggttaacaaagatagaagaaaatggctcaatcacttatatacaagatagggtaaggtcttttcatgagttggctctagccatcaaactttatctagatggcagcttatgctacttcttagctatgcagtcacatttgtgatgtgttaatgcttgcaaaagatacactcagaagaagaaaatgcaaaaataagactcaatagtgcagcacacagaatgacagaggtagccacctctgaaggtcagtaaaaaggagcagtagataccaatgacacagacatagtacaagaggtgggacctacggaaggcaggatctgggactgtgaaataatgctgttgggtaggctgttctgtctgctttccgtagtgacctcagcccaagtcacttgaaacccagtcatgggctgatagagattggccttggccatcttccaagaaaagtgaccggtgatgttcacatcctggacgatgaatgaagcagaaaggttctcaggcttagctagcaccttagaaagaacatgacctgcagcaatgcaagaaggaaaaccaggattaggcgactggagaaggtgtgcccaagggatccattgtaggaattttcagcggccagtctatgggatgatattaatagaagcaatgtgaccttgttctttaaacatgggttcagacaatcacccctttgacatatggggataggttgagtaggaatctcctcactccaactttgtactaaatgcttcttccagtcttttggggatcatttttagaatgctcttttgaagatggaggcaggagagcagtttagaccctggcaagacttaactatttcttaaagaatagcattgactgcagtgagaaggtaaatattaaagctgttagaagagttattaaatccgaagcttttttttttttttttttttttttttttaaaaggtgagatcttgctatgttgcccatgttggtctggaactccagggctcaagtgattctctcatctcagcctctcaaagtactgggatttcaggcatgagccgccatgcctggccaaatccagggcatttaaaagactttttcccactgcaagacagggacattggcaaggagatgggatggaaggtacagatgtgaggtttgccaggttggcatggaaagtgtgtgagtataacccacgcagcaaaggggtgggaaaataatgaaataattatatcaaactttcccaaaacacaagcggtatctaaatgtttgccttcatttccaaagggataacattactatcaaaggacatctttccaagcctgttaggctttaaaataacacattcattcctacatctcttccctccacattgggccatcataacacaacttagaaagagaggcacttttggttttcacggtcttgtgaaacgcagtttgacaaggtttgcaaagcgctgctgacaccgtagacctagatgtagaagtccttcaggtgaaaacgtacctgcttcgcccaggcagccaacaggcttgtggctcttccccttaagagcagagcatggtggagtagtgaagaaaacagcttctgccttggagtgactttttggccgtattggttggacagtcaccttatacttgcaggaaaatgacagatcttgaagaattatgtaattttcctagagcaagagaaagagaattatgctagcaataaatctcattagggattaaaaaacactggcaagaattgaaatcatattccatccaacaaggatgttttcctatatagtgtgtgcaatatggcttttataaaaagtacaaagcacatactgtccacattttgattaatgacaattgtgaaacactcccatggctgcgggatatgccttctagaattaaacagtatcataataattcctcatcaaagcaggctacttctaaggtcgcaatcagcatttttgagttggtagcagtgcaggtagtggtgtaaagctgtaaatacaaatctaacttttttcagttaaaaaaaactaacgcaggcttctctgagacatagaattagtttatatgtaagtttttctgttaaaaaatgatgatattctttagcaatataatttttcccttttttggagtgctgttactgttttctgccataatgttgtgattaaatataaataaaagaaagaggctaaatggtaaggagtcacgggctaagaatataactttatgataatgtcaaaagatgacatttcctgtgataacaggtgtgtatctctgtttctttcatatttggctaaatggcacttatccattctgttttgtatttaccaattcttaatgtatatgtataaaagtgcagatggatagctgggcatggtgactcgtgtcatagtcctagctactcgagaggctgaggtgggaggatcgcttgaactcaggagtttgtgaccagcttggtcaacatagtgagactccatggtttttacgtgtgtgtgtgtgtgtgtgtgtgtgtgtgtgtgtgtttaattattttttaagagaggaaaaaaagtacagatggaatatctctggcactcattggatgatgggtaggggatcttgctagaaagcagcagcgttgacgggaaaaacatgagacaagaattaaaatcaaaactgaggcttgagtgatttacttaagtgaggagtggaagtggctgcaggtgacagagcactgaatgttcaaaagagaccgggagtgacctccaggtgtgctggcccttcatccagatggtgacaggagatggggtgcacccaactctgcagccagttagcacaaacagtgaataggaaacaaatcaatctggacaacgcaagaccaacccaagcccaacccaagcccaagccaaggccaccatgtttctttgggagtctgaattgcttttctttggaaataaatctgctctttacatgggactatactggaatccaaggttagctattaaggatcctgtttcacagatatttcaagattgttttcatattgcataggagacagacatctgcagcagtaagtgaattagtggatgctccattgtagcataaaaacaaattataataattggatctaaaggtttaaaactaaatacagataagttctaaacccctagaaggataatttttcaggagtttgatttttatttctaccagatacattacatctgctcagcaaatagttgttaccactttcagagttcctaaagatgataagcctaggattggggaattgcattgacataagcccagttctgtaaggttctgaggcacacacatataagtaaaacaaaaacctcacccctctgcccacaaaaatattaataattccagcttctgtttattgctttctctgcttttcaaatcgacttccttatttagaatgtctgtttaattattttactgaaggtcacaaacattggagctaatttaaggataaatacaaggagaaacattgctgaacatgagacaaattaagtccagtaaaaaagaaaaagaatctgtgtatttctgaaaatccagtgacttgttttatctcactctcttaaaattatgccagcaggtatggttcttaaaatatcgtgcttgctttagaaaatgttcaaaacaaaaatattctagttacatatcacaaaccaaaacattctatgtttggggccatgtttttggattttttaaactgtcctgaggtatcacatataaactgccatcaaagtgtattatacactgtataataaaatgacctcttaaatattttgtgttagtttgttgattctaatctataattcatgaatgaaccccaaaatatttggaataacattttgggcaatattgacagagttgctatcctcagagagtttaatgttctcttaaagttgaaagtcaaaatattggtgcatgctatacaggacagggagattatttcactaactgagctgatggcagttagggacatggtgctcaatgatagagtcacatagaaatccacttgtaccattacacctttagatcacggtgacatgtcaaaattcagaaaataattcaaagcttttgtccagttaagatgaagcacacacatactcagacatatttccccctgaaatatgggagttctttaagaactgtgtctttagtctctgcactttaggttttgctccatgtggataacagagtaagctcccagtgcaatggtgtgaatggataaaagaatgagtgaatataatgaccattctgctttccacttccatcaagtcattactccatagctgatttgtgggaatgagttatctgtttgacctgtctagtttgtacatcctcctgtctaattatgttcacagatcaagttggcctagagatcatgtccttacgtgggtcatgccagatgatgcctctgatccggttgttctgttgtgggcacacgcttcaggaaaccaccgcacatgatatcggttgacagtgggatctataatgccaaaacacgcaaacaaaaataataggctggatgttacattccaggtagcctggggttcttgaacttgagaggagaaaaggagaggaaatgaaactctacaggtgaccaataaatgcacagtgagccaaaggaggtgagattctgattacttaataattataataattagtaattctgaatacttaatcattaagaacaaagtaagggaaaaaagtaatatactgccaagggaaaacctgtgttgaagtgcaagcactaagtagaaaaaaaaattagtaaattcatagcaaaatgattccaaagatgtcttgagaataacctagccatggtttttacagtaagcaaagccctacaatgaaaggcaacacctagcaacagctctcgtaattcctgttgcaaaagagaatcatcagaagtttctcaatcctacctttttttttgataaagatgagatactattgaatccacacaagaacaaaaacattcccttcacacttgcagaattggctatccacgtttatttcctgttatgtattgccataaagaagttcttttgtccaaaggatagggacgtatgcttcccactctcccttaaccaagcgcatcgtggcatttctgtatggctgatccctactgaaatatgacttggtgttctcaaacacaggccagaagactgaccctttgaacacgtttattcccagggcaagaggaatattttctgtacatttctttactttggacaataaagtggggggaaaaaagataaaatagcggcaagcaactcaatgagtgtgggaaagcagaccttgacagtctcgggtttattaatcaccccagtgtgtccgaggagtgtgaaatggcaccaaatggcaccattttgcaggtgatttaacatcttgtcccccaacatcatgccaagtgtttgatgggagttttcagaggagaaaactctttgatgaaattgggttgatctagtgggaacttcgctttgagcactttggaaccagaaaagaagaactttaaatccgagaaagcaaacagatataaaagtgggcactccgggcatttagctaaaagagaaatcatgtactagaggttttaatttttacatagcagacatcaagagtttattttttaaaaaaagaattataggctatgcacaacgctgaagtcaatcactgagtgtgttcatgttcttccattcaacagcaatgaaataatcacacaggagtggctgctgccctcctgaattttacatagtaatggggccaataataacagagaataaatacaatacatagataagatagatattatgttagaacgtagtaagtccacatataaatacagaaggtggctgggcacggtggttcacgcctgtaatcccagcactttgggaggccgaggcaggcagatcactaggtcaggagtttgagaccagcctggccaacatggtgaaaccccctctctactaacaatacaaaaattagccaggcgtggtggcaggcgcctgtaatcccagctactcgggaggctgaggccagagaatctcttgaaaccggaaggcggatgtttcagtgagccgagatcacgccactgcactccagcctgggcaacaagagcaaaactccgtctcccaccaccccccccccaaaaacaaaaaaacaaaaaaataaaacaaaaaaaaaaccagaaggtaagggcagtagggtggattgacaaaaagtgctgattttatataaggcggctggcgtgtgttcaattctgagtcaggacttgaagaaggtgtagcagtgggtagtggcactgcagagacctgtgggagggtgttctcagccagtcctgtccaacagaactggcgggtgtgatggaaatgttctgtctgtggtaaacactagtcacctgtgcctataaagcatttcacatgtcctctgtttaacagaggaatttaattctttattctgtttcattttaattaatttaaatttaaacagctgaagatggccatggttacaatattgggcagcttaaatgctctaccagcagggaatacacagcacgtgccaaagtgctgacatgagaacggagcatgacggatgactgaaggtctttggtgaagagcagtcaggggacttggggtggctacattacagcaatacaaggaggcttggctgccctggggatcctccatatcctaaaaatcctttacatattttacaatgcaattatattttcataggaggcagcatcaagagtgacacatggggcactccttttgggttccctcccttttgttagccctaaatctcgccatgtctgagttcactgcactttcatcttctctctgtgtcacctccatgaatcacttcattgattcccatggtttgaaaaatttttctgctgacagctcccaaatgtctactttcacctgagctagtcccttgaagagctgatgctccctccttcctctcccatgtggaggctttccaaactcaactttgctgtagctaccatgttgatttctgcacctcaactgctccttgcattcacacttttctttctggctgtaggatgcagaattttgaccccacacataaccttcgaggaaggtgggcttcagcaagcaactccaacagcctcagtgagcctcattccctgtatctgagaataaggatactaattcagccaatgcaataggtttggtgtgttttaaatcagttcatgtactggttttctacagctgctgtgacaaattaccttgagtgtagatgcttaaaacaatataaatgtcttctcttctggaggtctgaaatgggtgtcactggtctaaaatcaaggcaggcctgtactcctttctggaggctccagggaagaatgtattttcatgacttttcaggtttctagaggcttctggaattctttggctggtggtgcccttccaccagcttcaaagtcaacaacactgggctgagtccttcgcaccatgccatctctctgattcttgcactctgcttccctattctacttttaaggacttttgtgattgtattcgtttccacccaaataattaagggtaatatccccatctcaaggttggctttgagtcattgaatggcttttctctgccctctgaataaagacactaatactcagcctggcttccaggtctccactgcctctacatattcatctcatgcagacactcctctcgttcccaatgttttgtttgattctgtggttacttcatgaatccctgtcaaccccatttggttagagctccataactataaagataatgcctatttgctgtcactgttgcataaacaaagatgagcatggtgcctggcaggtgataaacagacagtaaacatttaatgaataaataagtgaacaaaggtataccagttcaaattcacttttatttctctactcattctggcaacagtgaaaataattccttataatctaagacacggaagaaagtgtgaaaagacatgatattacataaggtaattaaaagcaatctgagaaagtaaaatataaattaaacttagattaaaaatgccctgaaagtattgtaaatggcacccccaaatgaccagtatggggactaacaatgcccacactcatttatgtgagttgagctcaattttaacagatcaattcatagatatttgctttgatggaagtcatttatacaaacatcatgtccttagctttatcttgctaattactaaaatcctaagagcttgtattttaggttatgactgcaggtctcaatctgtaactagaatattaaaaatagcatagttcaggccgggcgtggtggctcatgcctgtaatcccagcactttgggaggctgaggtgggtggattgtctgaggtcaggagctcaagagcagcctggccagcatggtgaaaccctgtctctactaaaaatacaaaaattagccaggtatggtggcacatgcttgtaatcccagctactcgggaggctgaggcaggagaatcgcttgaacccgggaagtggatgttgcggtgagctgagatcatgccattgcactccagcctgggcaacaacagtaaaactctgtcttaaaaaaataataataaaataaaataaatagccaaacacttcctgaaaggctgtatctgaaaattctgtgctaaatacccagttgatctggttccttagcttaattccttccacaaataaatgacattacaaagaaagtacctgaaaagtatttttaagtgataaaaaatttacctgtaatatgcttcaactatggttcaaaaattagatgggtctaattttcttttcaaatagatgtaactcacagtgtctggcataaacaaagggctctaaaatttttcattaaatgtgaattcctcagttcgcaaaagtctaatgacaaagaatgatagggttattgacattagagctctgagaaagaggcaatccttgggttctccagaataataattgctttaaaaagaattgtaagtcacagcactagggaagggggcacacacttagagaggtgtcacagaatgccaattccatcagggtagggatttctgtctgcctctttgcagtgttttagcatcggaaatggtgcattgcatacagtaggtgctcagtaaaggttagttgaatgaagtcctctcatggatcaatgcctcatactctatctgtaaacatgatctggtgaaacagaactttctgatgtacaactaaaataagaatttttgagtatcacataggcatttctacttaaaatagaagcatgaatgtttcctctatgtctgagctaacttttcacatttacgttgtagagacacaaagtctagagccagaaaaccatcaagatgcagtggctcatgccttcaaccccagcgttttgggagtctgaggctgaaggatcacctgaggccaggagtttgagaccatcctgggcaacatagcaagaccgcatctctacaaaaaatatattttttaaaaaattagctgggcggccaggcactgtgggtcacgcctgtaatcccagcactttgggaggctgaggtgggtggatctcctgaggttgggagttcgagaccggcctgaccaacatggagaaaccccgtctctactaaaaatacaaaattagccaagcgtggtggtgcctgcctgtaatcccagctacctgggaggctgagacaggagaatcactcaaacccggaaggcagaggttgtggtgagccgagattgcgacattgcactccagcctgggcaacaagagagaaactccaaaaaaaaaaaaaaaaaaaaaagaaaagaagagaaaagaaaattagctgggcatggtggtgcatgtctgtagttccagcttcttgtgaggctgaggcaggaggattgcttgaggccaggagtttgaagttgcagtgagccatgatcatgccactgcactccagcctgggtgacagagcaagaccctgtctctatgacaaaaaaaaaaaaagaaagaaagaaagagagagagagaaaggaaaggaaaggaagggaaaggaaaggaaaagaggagaggagaagaaagagagagggagggagggaggaagaaaggaaaggaaagggaaggaaggaaggaaggaaggaaggaaggcaggcaggcaggcaggcaggccagaaagcttaaaacaattgtttattctattattacacagtaaaaatgaactaatatcaatggagtaataaaattactaacaaaattagctaagtggaattgttttaaaataatgtttgttctacaaatgcaatgttgaaaatatttattttctcccagagcattcactattataacccaactactatgtgtattaagtaaagaaagctaatatttgacgtttaattcatttatctatgaaactacatgctacatcctaataactgaaactgtctctgaaaaattttgagtgaaatgaatagatttgggcttttaggtccctaactccaagtccaaaagcaatattttgcccaccatcacttttaggaaatgtgacataagaacccatttctgtttatgattgagttttgattaatgagcaagattcttttcttcccttatttgccaaaagcattaagtctttttaggttttcaactcagtgtgtccacaattggaaataaattatcattcaaaaatattcagctacttgtcaaggagtttgaaaccactttagatgggtctattgagtttcatacagaggagataatttctcattttacaaagtcaaaaaaatccagaaaatccagccaaagtgtcctttcccatgacagaaactgtgctgatattcacattccgtacagtgctcctatgctagtaatactgagtccatttcaaaggtctcctttcctacatgtgtgataattatgaataagagcatgttttatgaatgtctggggaaactttggtttgggattctgtagatcatgtggtgagtacataaaaggtttctgtaaggaggaaaaatgtggaataagtttgaaacacatactttcctcttcattgttctttggacttcccaaagctttctaccactcccttctatcatgtgttcaacatcatgagctctgctacaatttatatgttcatttggctttcagatttaaaataacaagggaagtgggaatggataaaatttaagaaaaaggactttttggaaaatacgaaactctaattagagcatgagctgttctcagctcctaatagtaagtgtgtgtgtgatccagtggaaatcaactaacatttgcagatcccctgacagtatagtcagtggattgaccatagctccagtcaaatccacgatgctatcacagagctgcctcctgagctacaagtatgtatttctgactgcctatgacattttctggcaatcatgtagttatctcaaattcgacacaccaaaaccaaattctccatatcatggagacatatcccatgaaacatatcataattctactgctcacaatctttgttagtcgaagtactgttagtcattcaagctagaagataaacactccatttagatccatttctctttttctcttcaggcaggtcttaatatccaagtggccatacatcctggctttcctgggagagttacagtctatgtctgttggtggggaataatgtttacaaatgcctccttttattctcaaataaatcccagttcagacaataaattatgtggtcacttgtgtaatactcttacataactcgccaaccttcctcctcctactgctgtctctaattcatgatctgattatttcttgtcttggctactgaaattaaccgacgtgctctctctgaacttttccaatccatattccttgcacacttgcttttgctaacatctctaagtcctgctcagaatttcccctgctacttcacatccctctcctccatgtagaacaaaatccaagcttcctggcataccatataagcttctccatcacttgacattgatctgtctctccagcctcacacagtcacttcctcaatctcaccaatacttgacattcccgatctttctcccagctgcacctcttcatgtcctgggccagaagtgttcatcttccctggccaaaaaaagtaatccagcctttaaaatgtaccttaaactttacctcctctgtgaaaattcctctgcacacaacgtcaaaatctctctgctctcaactacttcagctgtttatccagactgctatgaagaataatgtcttattatgtggcaactgcctaactgcctaagcctcagaactgcaggttccttaaaggtaggaaatctctcttatccgttattgtattcccatcacgtggcacacagcctggcataaagtcggtaatttgtgtccatttgcaaaagaagacaaaaagtgaatggaaatgcattcattgatatctaagttaattcaaaggtgtttttttttgacggtgtctcgctctgtcacccaggctggagtcagtggcgcggtctcggctcactgcaacctctgcctcccgggttcaagcgaatctcctgcctcggtctcccaagtagctgggactacaggcatgcacccccatgcccggctaatttttgtatttttagtagagacggggtttcaccatattggccagactggtctcaaattcctaacctcatgatccgcccgccttggcctcccaaagtgctgggattacaggcgtgagccaccgcgcctggccaattcaaagttttaaaacttcacattttcaaatgaaagttgaacataccatttttggatgtattaaaatactcatctaaagactcttattactgtttgcaatgtttactatatatctaaaggattaacttaaaagaacaaccagacctttcttcccgttcttttttttctatatttcctttgtcactttaattgaaaatgaaaagattctgccaccagctgtcagacacaggatttgtgtaggaaaattaagctctatttgtttttacaccctattattttggtaaagggcttagcgtactcagtagagtcataagtattctgtctagatatttttacacaatgttctttttagattccaaactgtttgggaggatcttcctaaacaaggtaaaagcaaaatgccaaattccatatttttgccattcttttgaagggaatccataccaagtgttttcaagaacttcctgtcacttcaaagaaagttttagcgtgaatatatagagagggcatgagttgaaatggcaaggagcagatgcatggtctacaaaaaaatccacagaacaaatcctgacatgtcactaaagatgtagaatgaatctctgtctcttgagtaagcagtaacactgtaaccacaatagttttgactggaggctacactgtcaactgttgaaggccactgcacagaacattctcttttagaaatatatttgaaatcagttatatctttggaatcaaggttttggccagccacaaagagtgttctctggccagcatggatatgtacttattagatgatggcttaatgttggtctgtagtaggtagcattcctggaggttaactcatttcagaggctggaaatgggtatgaagaaaacagtttgaacactaactgactgcgaggcatttccattagtgaaacaaatcattactgacaaatagaggctagtttacctccgtcacatgagctcatcactcccagcttctcctttgtggcccagggtccaagtcactaaacatcaatcaagtcagcatcacttttggaacccaaatcaaggtcactccttgcctttggatcttgtccctttatcatcaagtccacaatttcatgcatcgtaaactggataatactatggactctaatattgattaataaatattgagacaattctctgcttatggtttctttaaagatttcagtatttgagaaaaccactgatattcttcacatttatttctaactttgagttattcaaagtaatacgtgtgtatatatgtgtacatgtgtgtatatgtgtacatatctatgccaacaaccatgtttcctatttgtcatgcactgaaatcattattgtatgggaatattggtcatattactgcttgctgatacagtgcagtgaaggtgaatctcttttcttctgccaaatttaataagatgcctaagttttgtagcacttgtattgcaaattggacaattaaatcatgtcttaaagcactgctctttgttgttcacaaaggagaaaacattgagagtcagtcctaaagcaacaccaagccttaaaaggctgggctcagaggctctttacgtctgtcctgacatcctgtcctctctctgcactataagcagtgccgtaagaatcctcacactgaaacacctaaggtgtctcctttgtgccaggcaccggtccaaccaatctggatgtgtaatctcatttattccacacaacagacctaggaggtgatctataatgtttcctctagttcatcatgttaatagaacaaagaagaaaaatgtatgatcatttcactagatgaagtaagaatatttgataaaaaccagtatccattaacaacaaaaactttgcaagtaagaagagtaggggattgtattaatctgaccagggatgtcttcaaaaaccttacacttaaacatcatgcctaatagtatcacttttagtcaccattgtactgaaactctcagccagttttaaggcaagggaaaactaaaacatcaaagatatggaaaggaaaatataaaattctcattatttacaaactagatgatggtttttgtagaaaaaatgcaaacaaatcatcagagaaaatgttataattaacaaagtgctaaaacaatattgctggattcacagtcaatatatgaatataaaatatatttataatataccaacaacaaaaatcagaaagtataattgaggaaaaagtatgccatctataataggataaaaataaacacaaataccttggaaaaatcatattaaaaagtatcatactttctatccaatatattataaaacattgttgagacaaaaattttaaacctgaatacagtggcataccatgtttgtagattggaacactcagtatttttaagatgcgaattcttcaaaatcattgacacgtggatgaattcaatctccataaatatctcaggaagtttttgtggaaatcgaaaaattaattcaaatatgtatataaaaatgcaaaaggccaggaatagttgagacaatttgataaagaaataaaaactagaggactatcattagaaatatttataaatctatagtagttaagacagtaaggtattgtcacaacattgcaaaaatatgtcaaagactctatagaaagtccaaaaattaacttgcacatatatgcattatttagggcaaatgaggcactgtagagctttggggaaaatagtcatttaaaaaatatatcatgatgtatcagagaaggagatcagaaggaaaaaaaaaaaagaacactgaccctctacaacaaaaatcaattctgggtaaaagagcttaagaataaaaggtgatatgatttggctatgtccccacccaaatctcatcttgaattgtagctcccataatccccacatgtcatgggaggaacctggtgggaggtaactgaatcatggggacgaggttttcccatgttgttctcatgatagtgagtaagtctcatgagatctgatggttttataaattgcagttctcctggacatgctcttttgcctaccaccacgtaaggtatgcctttgctcctccttcaccttccgcaatgattgtgaggtctccccagccatgtggaactgtgtgtccattaaacctctttttccttataaattacccagtctcaggtattcatagcagtatgaaagtggactaatacaaaagatgaaacagtggacaagaagacaagaaaggagaatatctttgtgacctttgtatgaaaaaggatttcctaaccaggacatagagaatactaaacctaaaggaaacaaaatgatgaattgcttatctctaaaattaagaaccactaagggctgggagcagtgcgcctgtaatcccagcattttgggaggctgaggcagggagatcacctgaggtcaggagttcaagaccagcctggtcaacatggtgaaaccctgtctctactgaaaatacaaaaaattagccgggcatggcggcagccacctttaatcgcagctactctggaggctaagataggagaatcgcttgaacccaggatgcggaccagcctgggcaacaagagtgaaactccatcaaaaaaaaaaaaacccactaagaagaaagttaaaaatgcaagagtggatcagagtggaagaaaatacttacatgaaaacaaatgatggctggatacagtggctcacgcctataatcctagcactttgggaggccaaggcaggcagatcacttgagatcaggagttcaagaccagcctggccaacatggtgaaaccccatatctactaaaaatacaaaaattagctgggcatggtggcacacgcctataatcccagctattcaggaggctgaggcgggagaatcgcttgaacctgggaggcggaggttgcagtgagctgagatcgtgccactgcaccccagactgggcgacagatcaagactgtgtctcaacaaacaaacaccaaatgacttgtatatactatattaaaagcactcatgcaggacagagtagctaaagagttgaaagagtccttcaaaaaagagaaatccaattgtcagtaaaattacaaaaaggtgctcaacttcttggacatcagaaaaatgcgaattcaaataacaatgaggtatcactatgaacataccagaaagggtaaacttacaaagatggaaaataccacatgacagagagaatgtggagcacctggaaccataatcatgccctactggtgagaatgtaaattggtacaaccattttggaaaactattaatgttttctaaagcttgacatactctacggcctaagaatcccacctctatggaagaatatgcgtcaaacaacatgtgttcgtggggcattcacactggtactattcttaatagctccacatctgaataagtaaatctccatccacagctgaaaggatacacagattgatgtatactaaggacatccaggcagcaatataaatgaatgaattgtttcatgcaacagaatgcattggtttctcataaaatgctcatggcaagaagccaaatacaaatagaaattgagtgattccattctgataaatttcaaatacaggcaaaacaaatattgagttttaaaagtcaggatggtggtggttactcttgtatgcttgagatatttactttttcaatagtagatgtttacattttcattttattacattatgtttaaaattttaatattaataaaatgttattttttaaatatgaatatgttgatattttaattaatcaatataatagatcaaatacttttcttatttaatatttataaaattattaactgtaatatagacataatataatcttaatgcaataaatgttgaataaactttaattaacattatagaaataaaatatgttaatattaataataatattattttacttgcagaatggatttcagcagcttgaaagaaaatcctggaataggaaccactccaacaccaatattgcttatggcacatggcccatcaataccttgagtaaaagtgaatttcagaggagtgaggagaattttaaaaacctaactcttgaaacaatctattctgcttatgtttttaagaggcataagagtgataaagataaaagactgtatgttgaataaattctaaaagtaccaccttgataacagaaaaacaaatattctaagactaaaaaaaaaaataaacaaaaagaatttatgctaaagataaatgttcaaacaaatgaaatgaatctatcctaaggataaatgtattgcagccttaattagaaaacagaaattctaaagaactgaaatgtttcattgtactggaataatgacatgtattatgatattaagatatacccatacaaagtagcatttatagaatgttatgaaaaatgcatgacaatatagcagctcaaacaatgttacacagaaatatgtgtgtatgttttaaaaacacactcacacacacacaccctaactgagtgaaagacagatgcatagaaaatttctgaaaggaaacccaccaaagtgctgtttcaggaaatgatattgagataataggtgactttccccccctactttctaaattatttgtattatggatctttaaaaaataataattaataatttataacaaaaattacagctcaaaataatgaatattttgagtgttttggatataacatcagccaatcagccctctgggaaagaaatgaagacaagctaatatccctgaaaggaaaatatttaagcaattgactgttgtagatttcaagatgtgagataaccgtcaactcattcagacttgtgttcaacaaccgtttgccttagtattgatactgtggcttgacatttacttcttcaaaactatctctatattactgtgctgtttaaagcaagtaagaaataagtaagtaatgtttatgtaccttctgtcttcttccagtagactttaacttgcagttggccatcctgatagaagggagctccgacttccagcgggcgagtgggtcgtcgtctttgaaaagggagttgtgtttgaattccaccttttctagttttcacaagctgttcttctacaacaaagtacaacattctaagttacttgttaaaagtaattatagattcctgggcaagatggccaaataggaacagctccattatgcagcttccagcgagaacaacacagaaggcgggtgatttctctatttccaacggaggtaccggctcatctcattaggactggttagacagtgggtgcagcccatggagggcgagcagaagcagggtggggcgttgcctcacccaggaagcacaagtggttggagaactccctcccctagccaagggaagccgtgagtgagggacagtgctatccagcacagataactacgcttttcccactgtcttcgcaattggcagaccaggagattccctcgggtgcctacaccgccaggcccctgagtttcaagtgcaaaactgggaggccatttgggcagacacagagctggctacaggagttttttttttttttttttttttttttttgttgttgttgttgttttagatggagtctcgctctgtcgcccaacaaagatcaaaagagacaaagaaggggaatatataatggtaaagggttcaatgcaacaagaagagctaaaataaatatatatgccaccaatacaggagcatcccgattcataaagcgtgttcttagagacctacaaagacacttagactcccacacaataatagtgggaggttttaacactccattgtcaatattagacagatcaatgagacagaaaattaacaagaacattcaggacttgaactcagctctggaccaagtgcacctaatagacatctacagaactctccaccacaaatcaacagaatatacattcttctcagcaccatatagcacttattctaaaattgaccatgtaattggaagtaaaatattcctcagcaaatgcaaaagaatggaaatcataacaaacagtctctcagaccacagtgcaatcaaattagaactcaggattaagaaagccactcaaaaccatacaactacatggaaactgaacaatatgctcctgaatgactactgggtaaataatgaaattcaggcagaaataaataagttttttgaaaccaatgagaacaaagacacaatgtaccagaatcactgggacacagctaaagcagcgtttagagggaaatttatagcacgaaatgcccacaggagaaagcggggaagatctaaaatcgacaccctaacatcacaattaaaagaactggagaagcaagagcaaacaaattcaaaagccagcagaagacaagaaataactaagatcagaggagaactgaaggagatagagacacaaaaaacccttccaaaaatcaatgaatccagaagctggttttttgaaaacattaacaaaacagatagactactagccagactaataaagaagaaaagagagaagaatcaaatagacacaatattaaatgataaaggggatatcactaatgatcccacagaagtacaaactaccatcagagaatactacaaacacctctatgcaaataaactagaaaatctagaagaaatggataaactcctggacacatacaccctcccaagactaaaccaggaagaagttgaatctctgaataatagcctaccaaccaaaaaaagcccaggaccagacagattcacagctgaattgtaccagagatacaaacaggagctggtatcattccttctaaaactattccaaacaatagaaaaagagggactcctccctaactcattttatgaggtcagcatcatgctgataccaaaacctggcagagatacaacaaaaaaagaaaatttcaggccgatatccctgatgaacattgatgtgaaaatcctcaataaaatactggcaaaccgaatccagcagcacatcagaaagtttatccatcacgatcaagttggcttcatccctgggatgcaaggctggttcaacatacacaatccatcacataaacagaaccaatgacaaaaaacacatgattatctcaatagatgcagaaaaggccttcaataaaattcagcaccgcttcatgcctaaaaactctcaataaactaggtattgatggaacgtatctcaaaataataagagctattgatgacaaacccacagccaatatcatactgaatggggaaaagccagaagcattccctttgaaaactggcacaagacaaggatgccctctctcaccactcctattcaacatagtattggaagttctggccagggcaatcaggcaagagaaagaaataaaggtattcaaataggaagagaggaagtcaaattgtctctgtttgcagatgacatgattgtatatttagaaaaccctatcatctcagcccaaaatctccttaagctgataagcaacttcagcaaagtctcaggatacaaaatcaatgtgcaaaaatcacaagcattcctatacaccaataacagacagagagccaaatcatgagtgaactcccattcacagttgctacaaagacaataaaatacctaggaatccaacttacaagggctgtgaaggacctcttcaaggagaactacaaaccactgctcaaggaaataagagaggacacaaacaaatggaaaaacattccatgcacatggataggaagaatcaatatcgtgaaaatggacatactacccaaagtaatttatagattcaatgctattcccatcaagctaccattgactttctttacagaattagaaaaaactactttaaattttatatggaaccaaaaaagagtccatatagccaagacaatcctaagcaaaaagaacaaagctggaggcatcatgctacctgatttcaaactacactacaaggctacagtaaccaacacagcatggtactggtaacaaaacagatatatagaccaatggaacagaacagaggcctcagaaataacaccacacatctacaaccatctgatctttgacaaacctgacaaaagcaataaggaaaggattccctatttaataaacggtgctgggaaaactgactagccatatgcagaaaactgaaactgggtcccttcctttcaccttatacaaaacttaactcaagatggattaaagatttaaatgttagacctaaaaccataaaaacactagaagaaaacctaggcaataccattcaggacataggcatgggcaaagacttcatgactaaaacaccaaaagcaattgcaacaaaagccaaagttgacaaatgggatctaattaaactaaagagcttctgcacagcaaaagaaactagcatcagagtgaacaggcaactacagaatgggagaaaatttttgcaatctatccatctgtcaaagggctaataatatccagaatctacaggaaacaaataaatttacaagaaaaaaacaaacaactccatcaaaaagtgggcaaaggatatgaacagacacttctcaaaagaagacatttatgcggccaataaacgtatgaaaaaaagctcaccatcactggtcattagagaaatgcaaatcaaaaccacaattagataccatctcatgccagttagaatggcgatcattcaaaagtcaggaaacaacagatgctggagaggatatggagaaataggaaggcttttgcactgttggtgggagtgtaaattagttcaaccattgtggaagacagtgtggcaattcctcaaggatctagaactagaaataccatttgacccagcaatctcattattggatgtatacccaaaggattttaaatcattctactataaaacacatgcacacatatgtttattgcagcactattcacaatagcaaagacttggtgccaacccaaattcccatcaatgatagactggataaagaaaatgtggcatacacaccatggaatactatgtagccatataaaggaatgagttcatgtcttttgcagggacatggatgaagctggaaaccacaattctcagcaaactaacgcaggaacagaaaactaaacaccgaatgttctcactcataagtgggagttgaacaatgagaacacatgagcacagggaggggaacatcacacaccagggcctgttgggggtggggggcaaggggagggacagtgttaggagaaatacctaatgtagatgacgagttgatgggtgcagcacaccaccatggcacatgtatacctatgttaacaaacctgcatgttctgcacatgtatcccacaacttcattattatataacctgatattagtcccagtgtacttcatttcatcctgttatttagtcatattaactgtctgttttttttttaagtaaaaggtggtgtaaccgcatgttctttcatgttcaagttaatgaacccccccttcaaaatccactggaatactaaaagtatattacatataatccccagtatttaatttggtaagtaacatatattcaccaggcttgaaagatgctccaatgtaaataataagtatgaataatatttctcattatagattttttatagttatgaggaaaataaaataatattacaataccatttcgtgaaaaaagtagataggttttcgtggaaaacctatacgtaatgtggaagtatgagcattatacatcaatacttggtgcagggctctaaacggaaatacggttcagctttgtcaaataaatagtaaggagcaaattgcacctactcagttgacaatgccaacttcagcttcatcactcagcaaccaatctgtgtgccattcagattagtgacagacatccaaattctgacagacattgaaatgaaactttaaaatatccagtaaatgaaatgaaatgcaaaggcaacagtacatcaggttgggtaatggaatacaagaacccattcagtaattagctctttctggcagtaattagctctttctgtcagcaattctgagcacttcccaagagccaggcattgagctaggagttgcagagataaagtttttgtacctgagggactcctgaaataccaccaggcaaatctgctctaatgatggtgcaccggcagtgagcttgaccaaaggcatctgcccagtagaagagcatcagtctgaccagccactgtttctgttcttcgaaaaagtggccacaagttttctgaggaatggagccatgggaatataactggtgccatgtgacgtggtattttgtgaagaaaccaggacacttcatgaaagatgaggcgagagtatgttcacatgttcattattaaaagcatgaacttttttttccctattgtccattaaaagtgtattcaacacatattcgttgcaacgtaggacaccacaaaactgaacaagaaggattccaagccctacgtatcccatatccagtggaagatagagatatgctactataaatcaaaacaccattaaatatatctttgaatcaggtagttcaagatttcattcttagcctaggtcatttcttactgtgttgttgtgtagagtcatgatctgactccagttttagtttgctttttattattttgttttaatttagctgtatctttctctcttgtgccattcctaattccccaaacctgctggttttctttgtatctataattctgattgctttagctcagaatggaccagcactacttgtttctgtcaaccttctttgcccatgaaaacttctcagaggctctccctggtgaagattttccagagtgaatcaaaacacaccactcttttgtgttcctgtattttttcagttttaagtaatttttttcttctttaatttgttcctcaaactcaacccagaagtcctctacaaaacagagctcatcctaatcttccttggatggcaactgcctagctcagaaacacgcacatggtagctgcctaatatgtattggatgaaatgaaataaataaaattatgaattgatggctgtttataccaaatatattaccaaatgctcatttgcctggggctattcggggtgttttatttacgtcaatacagtaatcctttaacatgagattcaaacatgttgcagaaagggcaataaacctaatatttgtttttctttggaaacagggtttcccaccattgcccagattggtctcaaacttctggctcaagtgatcctcccacctgagccccctaagtagttagcagtataggtacatgccactaaacctcacttttgactccaggtgtgttcctggggggcttggttggggtggtgaattttgacactaatttatattcatagagccatcctatgaaattaagcaggggtcagtaaactaaacttttcttaaatggccagatagtaaatatttttggttctgtgcatcatatggtaaatgattttggttttgcagactggtctctctcccaactactcaattactgttgtaccccccaaacagccggacatgatatataaatgacatgtaagcaaatgtgaccctgtgccaataaagtcttatttacaaaaccaggagggggctggatttggcctgtgggccatagtttgcagacccctgagaaagaggaattggtatacactgaagacgaaaaaaccagcgctcaaaaatactaagaattgtatccagtttcacataattcaaagagtgaaggtgaaatttaatcccagggccatcccatgccaaacttctgtttccatcaccatgtactgagtcttacagagcacccatttatatggtttaataattaagacaccaaaaatttccttaggccccaaatttctccctcatccactcactgaatttagaggttgcatacatagaaattctgccctttgatgcaagacttttctgctttctgaatttcaaatagccctctgagagataaaagggtaagctgtgttgattttatgcctataaacaatgtgttatcgaaactcttctaataaaagcagtgaggtttgcattcttgggcaggtgagaggaagacagaaagatgagatggagagaacatgcccaacctgcggtaagacaagatcagtcaaggaaagctgtggaccccagaagataatctacatcaactcaatttttcctgacactggcatgcccaatgaattgtctatccaacggaccagatgaaaggaaaataaaaacgcacatttgttagattcgcatttaggctattttagcttaaagagttcaaatcaatgtgtggataactgagaatcatttattttattttattttattttaattttttttgagacggagtctcgctttgtcacccaggctcgagtgcagtggtgcgatctcggctcactgcaagctctgcctcccgagttcatgccattctcctgcctcagcctccagagtagctgggactacaggcgctcaccaccatgcccggctaattttttttttttttttttttttgtatttttagtagagatggggtttcaccatgttagccaggatggtctcgatctcctgaccttgtgatccacccgactcggcctcccaaagtgctgggattacaggcgtgagccaccgcgcccagccggctaattttttttaagagacacagtctcactatgttgcccaggctggtttccaactcctggcctcaagcaatcctcccaccttgacctcccaaattgctgggattataggcatgagctactgtgcccagccaggatctaagagtttcacaaacccatttatgtttctaataatctgtgataatattgagaactcaccagcagataactaggacagataatcagtttagatagatactgtgtttagatactaggtttaagctcaatgtcaatcttgtcttcctacttgctttatatcctaggcaaactttttctttctttctttcttttttttgttttttaaacagagtctcactctgtcgcccaagctgtagtggagtgcactggcatgatctcggctcactgcaacctccgcctcccgggttcaagccattctcgtgcctcagcctcctgagtagctgggactacaggcacgcatcaccatggccggctaatttttgtatttttagtagagatggggttttaccatgttggccaggctggtcttgaactcctgacctcaagtgatctgcccatcttggcctcccaaagtgctgggattacaggcgtgagctaccgcgcccagccctaggcaaactttagtatttaattatagatgtaaaaacatatttttatatatcttaagattgaaccattgttgctttattaaaatgattcaagaagagaaatccaccaacaattagtgttgctgacacacgccatgggtaaaaaacagataaggtgcatactacaatgctagcagtatgaccctgactttataagaatgtctcctccactttcagtaataagcaaaaatggaatatcatatctacaatattctgaaaaagttatgatgtctgatttacactcgatagtcatagaaattaagaaaataaaatatgtacactatttttcaaagatccaagttttgattaattttatagatcatcaagagattcagagtattttctctcccatctattcttgttctggagagccagaaaataattccagttccatgaggcaactataaaacatttggaacctgtcaaacttgaaaatattcctcctgccttcaaagaagcaagctacctttccattaaagacaatgttatatcatacttccttcaagggattgtttcataaaactgcatgaacattcagccttcacttgaatagaaatgtttatcattaaaacacctagcagcctgcagacctggaaaaatataattcaaaaagtaatttatatagtgacatttactactctccttcctataaaatgtaatttcccttgcttatactgtaacgttgtaattattctttacttctagttggttcatgatgaaatatataatgttcttataaaagtcacagactagtgtttatgagattatatatcaacactgggatataaaatcctgacaaacattcaactgtatcctacataatccgttgaaaagtcaatctcttctgtggaatcacctgagacccaaacaatgtgtgttactataggtactttgcactatgacttcttttttcttacttttcttttattccttttctaatctatgtaagaggaatcagtcctgagaataaagtggtctttgataggttaactaccatatctcttaattaactaccctatcttttaattggtcagctaaagtattacctagttttaaaagataattagcaaaggaccttaacacagggaatcaaccggtcaaatagatttctttcatttaactgcctgttttgttcatttaactgccataattctagtgtctccccacctggctaaaaactctcactggtaaagataattcctttggaatagtcaaccaagtgaaaacacaaactcttggaggacacagttaaaatatgcaaatggcttgtaaaagatgtccaaccttggttgttccaagatgacaccaaaagccatttctttctctcttcccctttagtatttatgaccgtagcagatgaaagcttaagaaagctgtcgtgttagagtgtggcacagagctggttgaatggaaagacagttgcattcagctgagttgcagtcaatttactgagctcttactatgttcctggaaaattcaagaaacctgtgggtcctgaaataattgcaggacctagaaacaaactgaagtgaacagaaagtggtaaaaggaagtctcccaagtttctggtcagtagtaacctcaatggagaccagagatacatgagaacatcgagctttgtaagtggagggagtgagttcaatgtggagtatgttgaggttgagatgcctgtgtgacattcagatacagggaatgacaggctacagacatctggtattagtggagaaatcaaggctggagctgagtcattgagaatggaccatgagtaggtagtgactaagttgtcagagcagataaggtagaaccctggagagctccaatgtccaagagccggatggaggcaggagatcctacaaggaaactgaggtatgagaaaaattaagacatctgggagtcaaacatacaagggtcaagatgtaacaatggggaaagtgtagttaaacaaggacaaactcatcagaaatggtcaataaaattacaatggaaaacatccatcagacttagaaattagcaggggcagatttggtggaaaagtgagattgaaaaatagattgcagaaacttgagaaaaaatgtggaaaggagaaagataagatggtagctagaatgaaaccagcatcaatgaaaggtttgctttagaactggaagctgagcagatcaagccagtggagaggaataggctgaggttgtaggcaaatgagggaataactaattaacttggtttcaaaaatatttttgttgccgtgtttatatgccagggattatgacggatactgtgaccacatatgtagataatccatggtctctgatgtagatgagatttgacttcagtggatgcaggtatctgagttggggaggaatgggtctagaaactgcatggtgaagtccaccacatgcagaaggaagggtgcctccaccttagaatacagaagacaggagaagataaacatggacataagaatagatatgtttatatttatggggaaccgcatggcttactgagaggaagggatttagactagactgtgtactccatgtaatagatatgtttatatttatggggaaccgcatggcttactgagaggaagggatttagggactgtgcactccatgtgcaatgtggctcaaaggagagaaaaaggtttataatcatacttgagagggtagcagaagaagctaattaaagaatatctccctgagttacagggttgtgtggggatgccccaggaagggtgaagaagctgtggatatgctacagagatccagggttccataaaagttttgtctgtgggctggaccatgacaaggctctagataatgtaacctcaacaaggacaagttgaagtcggactttttttctccttgcttttggttctggaaattaacagatattaaattatgggaatttgcaatcccataccagtttctaatggggaaagaatgttgtttattggaagaaccaggagactaaaagacatgcttattttatacaatagatgaaatctccaccaccagtagagaaagacagctcttgcatgaagctgaagtttaaaggattttggcctgagaagggggttggtaaggaatatagaagaatatagtgaaggatgaagttttggggaaagagagaattgaagataactaggtagctgtcttgagagtggaactccaaaaagagagagatctgtaactacgctgatattttctaaagaaaactttgactgctctttacaaagaatagatatttaagaaagagcagaaacataatactaattaggagactatttcaatttataggaaagaaaagacaatagcgtgaacaagcgaaagaactggacagattccatatggaatttaaaattagagacaaaaggactttctgaagaattgaatttctggagagaaaaaacagagaaaaatgaagaatgacttctgcatgtttggcttgagcaaaagggtgaatgttggtgccatttactgagataggcgagcccaggagaggaacaggtatgggcgaaaatccagagcttgtgtttgaacgttttatttgaaatatctgcaagccatccaaggggaggtgctaagtgggtggctgaatgcaggactctggagttcaaagagtggtcagggtgggagggcagggagtcattagcacacagatggtggttaaatccttgcaactcaatgagacctccaggggagagaccagtggcccatccaccttcattctttcctcacgctgagttctctgcccatgcaatgcgcttctctaactctctacactcatccacgctgctgcgtttgtgtggaatgatgtccattccttgtgggcctgcagatcgctcactcttcaggacttcatgagggatgatgtgactctcattccccaactccatgttggtcatttctgcttccactgtttcctgtagttctgtctgtatgcaacacacagatctttgttattattttacatatttatctcccaaattcaaaattaggcacttttaaggcagaaaccaaaatacatcatcgtgctaggaataatgtatgtgtgtgtatatatgtgtgtgtgtgtgtgtgtatgagtatgtatgtgtgtatagttatgtgcgtgtttgtgtatatttgtagacacatgtgtatatgtatgcatatgtgtacatatatacctatgtgcatactatttatagaaaattatggaacatattgctatacagtacgtatatatagtgtatatagtgtattacagtatatagtgtatatataatatagtattcctggcattagacacagtgatgtcataattcataggcacacaatttcaatgcgatgggtagatggatgaatggattaaaaatgaatgaggttactaaacatatttccatgagaacttttaggtaaaatttatattgtaccgagactcacataaaaattgaccatttcaagtccatttaatctccaaagagactatttctcaaacagatagaaatctctgtttctggaccattttttgaagcattatttcaaacaaacctgcccatttggatcctacgttttcccaggggtggaaggtaattatgagcaacccctgtgtctcactctgcaggaccagcattgcctttcctaaattcagacaaatgtttaacacattcttcttctccttctgaacaaggcccactgtcctgatcaaaggcagctatgatgacggggtcctgctagcctaaaaaatcaacatcggaggagcccctgcgacaaacgcctcctccctcctactctcatttaatttgtcccagtttcctgaaaccttgctaggagcccctgcatggcagttctaaccggtatcgacgtttgaacaaagccagaaacatcaagtaacttattctctaagatatgagtgtcatataagaaagactcttctattgttttgctcagttcccagcaaacatactaacatactaggtaagaaaaaaagaaacaaggaaaagcaatatgagaatgatttagtaacttcactcaatggagtattaagtaacctttcaagcagtaattatgaccactgtgtagtactaggaaaaacaggcatgccacaccactttttgtgccccctatccactcgcgtacatacaaacacattattctcagtactatgatttattttggtctctgccttcaaaagtgcccaactttgatttgggagataaatatgtaaaacaattgcacaaaaataagtgtattgtatacagaactagagaaacactgtaatcccagcactttgggaggccgaggcaggtggaccacctgaggtcaggagctcgaggccagcctggccaacatggtgaaaccctgtctctactaaaaatacagaaattagccaggcatggtggtgcacgcctgtaatcccagctactcaggagactgaggcaggagaaccgcttgaacccgggaggcaaaggttgcagtgagctgagatcacgccattgcactccagcctgggtgacagagctagactctgtctcaaaaataccaaacaaaacaaaacaaaacaaaacaacaacaacaacaattacagaaacagtggaagcagaaataacatcaagttataacagtttaactgtacgtaatctcctgaaaaacaagtatgcagaatgcatatgtgcacgtcatgtaaacataaaaacagtcaatctgttaaaatgagacacaataagttttcttaaatttccattacaacaccaaaattgcacctacaatagataaaaaccataagaaagaattcaaaagtcaaactgtttcgtatgtcgtagtttaaatactttagtcacatgcatgtgggtaagaagatttgccatataattattccaaatcaaaaactcactctccctccattgtgccttgttgtgatatggcgcccatcatgtcacaatcatcttgaaaaacatgacacagtcacttactgttgttggttgcatgtgtcgatgtgaagtgaagggacacctttgcactcttcagccgtgtctgtccccagtacgttatggcttgcaattccacaacatagtcacagtctggctggagtttctccaggatcacagaattttgaaactagaaattaagagaatatacccaaaatgcgttacaaaccttccacgtctctcatcttcattgcaaaatctcgtgtgtcattatgaagcatgccaacttctgatttcttttaccaacttttctatatctttgggatctgaaaattcagttttactactgatcaaaataaacttcaggccaggtgcggtggctcctgactgcaatcccagcactttgggagcccgaggtgggaggatcgcttgagcccaggagtttgagactacctgggcaacatagcaagactgtctctacaaaaaaaattaattgggcatggtggtgtgcacttgtagttccagctactcaggaggctgaggtgagaagattgaacccaggaggttgtggctgcagtgagctgtgatcgcaccactgcactccagcctgggcaacagagtgagaccctgtctcaaaaaatataatgaaataaaaaataaaaataaacttcatagaaaggccaaatgtattttgaaatactgtttctaaaccaattattggtctcagataccatggaaataaatcattctgagccctcgccactctgagacaccacctctcgaaggaaagggagctgtttataataaagtaacagagatctatgttgccacatacatggaaaaattatgaattggcactaattgcaattctttgatatctgttctaaattttctaggagcaaatttccaccaaaagctatacaaaagaaaaattaacttgacaaaatgcttcaaggtgcttcattattttctgtcataatgtattgggcagggggctggagggtgggacctgtcagcatttcatcatgtcactttttgctctagattcctaagtgattccccaatttcagctcttccagctcatgcaataagtgtgcactaccattatcatttgtagcaaaatccttcaatataaaaaatggaactgtcataaaatttcataaaaataaagtggggctgggcgtggtggctcacgcctgtaatcccagcactttgggaggccaaggtgggcggatcacgaggtcaggagatagagatcatcctggctaacatggtgaaaccctgtctctactaaaaatacaaaaaattagctgggtgtggtggcgggcgcctgtagtcccagctactcgggaggctgaggcaggagaatggcgtgaacccgggaggcggagcttgcagtgagccgagattgctccactgcactccagtctgagagacagagcgagactccctctcaaaaataaataaataaagttaaaatagtataatggctaaatatcaatgataccaactttttgaggcatgttttataattctgaagagcacagatattgaaatctttagccttgctatcttttcatttctaaacatttatttatggaattcaactttataagtgataggaaaaggtatttatgtaaattttatgacaagataaaggaatgtatactaaaaggaatccaaataactatttttatgcagtaagcatttcaaataatacaagatgcttgttatcataagaatctcattgcagaaaatggttcaatgaagattttatttcttggcatctgacggataaaccactccagatccttttaatcaatgagaagaacatattgtgagacgtggccttcctaagctgttactgctcagtgattagattacagacggaaacacttcgcaacagaaaagccatgaacatccactcttccatttacaaggatctctctctctcaaaaaaaaaaaaaaaaaacttaaaagtaaagtacattttgcataatatcattttctatggccagacaggtaagatggggatcatttaaactgttcctttgatttccagagttctgactgacatttagataggagtaggtcaatggtctaaatgcaaatgcttctgcctaaaatataaaaggcaaaacagccggcatgcccctgcattctgtgaacttcctcggtagaaatgaatgggagggaagctttcctgcatccatggcatctctcagtttagcagaggcctcttttcaggccagttgccttgagttgaaataccctctgtgggaataacaatccttcctccagttcccactcaccccatccgtagtctttctccgcttcttctttgttgggacaagagacttactgctgaccatccagctccaaaagaccttgtaatgatgcacagggatgtccggctcctcggggagatcccaaactatagtgacggtcacactcccatcactgttgacggtggagttggccagccggaggttagccggtgctggtggggcagatggatctgaaatcccagtacaaagacacatcatatgactccacaaaactaacatctttggacatgtaatgactacatggtcaacacgtgaagcattgctttttatagatagaaaagctgaaaacgggggtggaggggcatggtggctcatgtctgcaatcccagcactttgcaaggctgaggctggcagatatcttgagctcaggagtttgaggacagcctgggcaacatagtgaaaccctgtctctacaaaatttaaaaaattagctgggcagggtggtgcatgcctgtggtcccagctactcaggaagctgaggcggaaggagcgcttgaacccgggaggtcaaggctgcagtgagccgcgattagcaccactgcataccagcctgcgcaagagaatgagacactgtctcaaaaaaaaaaaaaaaaagtaaaagaaaggcaaagctgaaaacaagcagttaagtaagatctccttgttaagcctcaaattaaaagatagagtattaaacagtaagataaatttgtttggtccaaatttgtaatacagaaggatcgttttaggcatttccataccacggcaacccagccaaatttttactgtgctgaaattgacatattttagtaaaatatagtacaattcaatgtgggtgaattgacattaaataggtaagcaacaaagaatcaccttttaacactctgaaaagaaaaagaaattcagctcataaaagcaattgttttcatcttcgtgccctgtagctagcaattcttgcatcagttaagaacaataaagggaaatcagaaaagaaaaaaaatataaaaacctgcaccattttttatccacattgcacactggatgacttatggatagcattcatttttgtgattgtaccatttctggtttgtcttattaacaaaaaccttctcagctgtcaagagaaagatgaggtgctggaattaccacctcacaaatctccactgaaaatacatatatgaagaagattaaatataccaaagctggagggtctttacttcattttctattacaaattgagcaagtggagatgctgctcaccaccagtgatttacagagggtttcatttcaagatgccatcacgggaagatgctgtcaataattctaattatagcaccatctgtgttggaggctcaaaaaagtaatatctaacttgatatacatgaagaagactggagaaaaaaaatccttgtttttattctcagtcatttgtggttttggaatgatggaaacataacttattttttgaaatttcttgctttcctctatgatatatcatgtctggacatttagttaggttagttcctttattttctaaaataagaaagcttcatagtattttttaggtaagaggctaattgaaagcatattatgtgatactgctagtcaagtcattttttttttaaattaacttttattttcagttccagggtacatgtgcaggcttgttacagaggtaaatatgtgccatggtggtttgctgcacaaatcaacccatcacctaggtattaagcccagcaaccatttagctgttcttcctgatgctctacctccccacctcccccaagcaggccctggtgtgtgttgctcccctccatgtgtccatgtgttctcatccttcggctcccacttagaactgagagcatgcagtctttcgttttctgttcctgcattagtttgctgaggataatggcttccagctccatccatgtccctgcaaaggacatgatcttgttccttttcatggctgcatagtattccatggtggatatgttccacattttctttatccagtctactgttgatgggcatttgggttcattccatgtctttgctattgtgaatagtgctgcaatgtacacaagtgtgcatgcatctttataatagaatgatttatattcctttgggtatataaccagtaatgagattgctggatcaaatggtatttctgagtcaagtcattctcaatcaacatcaggaatctctggaatgtccaagacttatactgggatatgctgattccctgagtgcaggtgggacccaggattatgtatatcttatatgaaacacacaggtaatatgaggtagatgacctgcaggtcaaaagtactgcatcaggtggctcctatgaggtctgaacatcacatatgtaaggaggaaatgtatttttcctgtcgttattggaatgggaagcaccccaatatggaggtctggcagagccatgtgaggactcccccagtcatcaatattcacaacactgctgatcacttccttctctaagaaatgcaggcttcatttggtgttcaggacactactctactggatttttttttttttttttttttgagacagagtctcaccctgtcacccaggctggagtgcaatggtgtgatcttggctcgctgcaacctctgcccgcctgcctagtttaagagattctcccaccttggcctcccaagtagctggcattacaggcacctgccatcatgcctggctaatttttgtatttttgtagagatggggtttcaccatgtttgccaggctggtcttgaactcctgacatcaggtgatccactcgccttggcctcccaaagtgctgggattacagatgtgagccaccacgcctggtctctactggattttcattcagtttcaacagaagctatttttcagccccatgctccatgatccttaacatctcataatctctagacaggagagtgttctgcatctgaattcaggggcctctctcttctcatctacactcactctctagggatctcatcaggtgtcacagttttaaaaaaatctttgtgctgataactttcaaattgatatctttaacatagactatgctcctgaatgcagatccaatcattcaaatatcaatactcaaaaaataccttccagtagctccacttggaggtctcagaggcatttcaaaactaatgtgtcccaaagaaaaatcatgatccctatgcacagcccaccaccaacacatatcctaccacacacagcccaccactgacacccccatctcagtacatgggaattgctctttccagttgctctggccccaacccttgaagtcatacatttattttccactcatatctcttgagcaaattgtgttagcactaccttcaaagtgtaacaggaatttaactgccttttaccacttccaatgccctgggccaagtgccaagggctctccactgcctccctagaggtttttctgaatacagcagtctgatgattctatactgccagaccatgtcactcctgtgcacagaatctccttacttagggtaaaaacccaggagtctcctgaatgccttgcaacccgtgcctcagttacctcccagagcacctttcattttatcacctccacccctcagcccagccacactggttcccatgctgtttcttggagaggaaaaccgcgatgctactgaggcttttcctctccctttgcctaaacgctttccctgatgtctccacggctggctcctttcctgctgcaggtggtgaccctatttaaaatagctacatatgctttgctccatttaccaaaaaaaaaaaaaaaaagtcaccatgattatgccttgctttattattctccaagcccttattactaactgttatggtaaatattgagtgtcaacttgattggattgaaggatgcaaagtgttgatcttgggtatgtctgtgagggtgctgccatggagattaacatttgagtcactggactggaaaaggcagaccctccctcaatctgggtgggcaccattccaatcagctgccagtgcagccagaataaaagcagggagaagaatgtggaaattttagactggtttagtcttctggcctacatcttcctcctgtgctggatgcttcctgccctcgaacatcagactccaagttcttcagctttgggactcagacctttgaacacagaccgaagggctgcactgtcggcttccctactttggagttttggggacttggactggcttccttgctccttagcttgcagatggcctattgtgggaactcatcttgggattgtgtgagtcaatactccttagtaaactcccctttatatatacatctatcctattagttctgtccctctagagaaccgtgactaatacacaaactgacttattaggtaccttgtttgctgtctgcttctactcacgataatgaaagctccctgagaggaggaatgtttgcttgttttttcacatctgtatctccagagtccagaagagcacctagcacacagtatgtgctcagtaagcaattgctgaatgaataaatgaaggacaggcttctaaacgttagctttgatttgtaatgtgatatttcagtttcaggttcaaactctgtcaatcagaattgctagatcacaagatcctaaagtgaattgcaaaatcaaaggagtgttcttcccagtttgaaataaaataattaaagcaacacctcttcctctggtgtaggaatcaatccttaacctacaaaaggtagttaccaacctttctgggagggaacctagtttacaactgaatcgtcacttcaaggcaagagaagaattaaaatgtgtgaaaataacagccgttcgtgttctcggcaatgcacctgaatgtctatatgctgaaaataagtagtcacatgaatattgcagatattctaggctcagaaggaaaagctcaaaataatctcctcttctaaagaaactctaacatttaagaaggtcactgaatttgatcatcttctttagtttatgttattcattacatcatttcctgccctggaaaatttttcttagatgttatcataataatctagaataacatcatctattttatgaaacattatgaaacatgaaacaacacaatttatgaaaacaacatttgagaaaacaatgcattaaaagatatgaattaataatattttctttacatttttctcaaaaggaaggcccattttgaatttacaataccaaaatggcaaacttccattaccaagataaggtactcccatctctttctcccccaaaataatcaccataaaactgtaaaaccaggtcagacatggtgacccacgtctgtaatcttagtgctttgggaagctgaggcaggaggattgtttgaggccaggagctcaagaccagcctaggcaatagagaaagaccctgtctctacagaaaaaaaaattttaaattagctggggcatggtgttgtgtgcctgttgtcctagctactcaggaggctgaggcaggagaactgctttagtctgggagttcaaggctacagtgaggtacgactgcaccactgcattccagcctggatgacagagtgagattctggctcttaaaaaaacaagaacaaaaagaaaacaaaaccaaaagagagtggcagcgatcacctgtttgttgccgtgattctcctctgtaaaccagccattcatttatccatttattcactatggggttcaggtgagacagggtcaatccagtttctctaatctgaagcattttactcagtcctaacaagtttctatatctaagtcattctctgccttgagaattggttccctacgttatgaagcaaggtgtattcattcggctgaattatacagaatgttttctttcattatgcatgatattttaattgttttagaattttgaaatgtagttggagatttccatgtgaaatttatatatatatatacacacacacacacacacacacatacacacacacacacacacacacacacatatatagatgtacatatgcataaatagacagtggctgatgagagccagagagtcagagagggaaactctatacgttattataaagccctaaggaattttacaacttatttcacctttttttaactggggagggttttaggggtcagagaggtaaagatatatgtccaaggtcattcacatcattgatggcagaacaaggagcgtgagaacaaaaaggaaaggagaaaaacggggttgaaggtctaacaatacacacctctacatgccacactctacatatatattccaccatcaaaataagggacaatatccctacagaatgtaaaaattcaaagccttttaatgggaaaagtgtctgttacaataggctagtgcaggcattgataggccttttctggaaagggccagatagtaaagattttaggctttgcggaccatatggtctccgttacaatcactcaactctgccctcatagctcaaaagcagccacagacaatatgtaaacaaatgagtgtggctatgttccaataaaactttatttgcaaaaccaggttgcaggccaaatttggaccctgggccacagactgctctcccctagttgggagaatttcaaaaagtgtgaaaccattaggtttaggaaactcgacatgagcactgtttatccctaattttacaaacatacagctgcattttgtctattaaatgttaacattattgttcttattttagagatggggaaattgaggatcacagtttgattcactacttcaagagcagagtttgatttactacctcttcaagtgagaggatgggaggcacaccacaagaccagtgctctcctaacccttcctctgagtctcaaatctgggcattttcccccagctcacttctctttctgtttgatgccaactccctccttatgatcttcacaattatctgcagaaacacactgcagagagcaagcacattttcagagataactgaaataggaaggctgtattagctccttctacgctatacaattagtgtgattaccaacgtaaaatatgctaaatatttagcatgtatacccaatttcagccttggggaaaaatagttccttttattgatgatcacatgtggtgctttcaggagagaaagatggaacatttggatttcagaaagataaatttcaggtttcatcacttaacctcttgtgtttcatgccacaaacaggcaaagtaacaagcacgaaggtttgacacaatggaaagactttgagcctatgttgggtaaagtgacaataaaatcacttatcacccttggagaaatgcaggcctattattgcactgacatgaatctcatgggaaaagaccacttctgcttgtcccagcagaaatgccatcactttttctgaggcaggctcctctaggtttaagacaacactatttgttaaatacagaaacccatgaggccataaagagagcaacgattatagatcatcataaagaaacatgcacatgtgcacatggagaacaatacctatttcaagaaaatgaatgttgattttacttatttcatttctaccaataatgtctatagattaaacttcgcactgaaacgcatcataagaacacctcataaggtatacttatggtatatacttgatgtaactttggtcaagtgcagttatattttaaaaacaataatataactgtgtcacaaagttttcaactaaatagaagtttgcttctaataatatttaaacctttttttttctttccagacttggcagttggggtagtgttccttctcccttaaaaaaaaaaaaaaacttagcaaagctgctgaagctacactgcaggcaaatttccaactattaaatagtttcaagacatatgtacagccaagccttttgcccattggaaatggcacatcccgagcagctgtggaacagagtaaaaagtcatgggtccccacggggcaacagggaactttattaccatcagtgatgtctgctctagttttactgacactctgtaatgcatgcatggaataacatccagtgtgatacttatatgctgtgaaaacaatgctgtctgcttccttttcctttgtaatgtatcctatgcacatggagaaataaggagaaaaagatggatgaagaacttggaatttagagggaaatgaatataattactaaaagataatatgctaggttaaggataatttaagttggatttttatgtttcttcataagatcccttaaaagtgtgttattttgtgatgtcaaattgatattgactaatttcaaatgaacaaacatgcttgcccgcttttggcaacatatcaaaaaaaatgaatttggattttgccttatacaatccacaaaatcagaactcttccttcttttactacccatattgacacatagatgtagtcacagtagccagaaacaaacacattatttcccaaattcagcaaactggtaaatactattttgtaataggtagtagctacttagcaatatatatttccaatcctaagcatgcaatattctgtatttttgtattttgtaattttgtatttactttatttgtaaaaatacgaatgtttatttgtaaaataactatttttactcatttgataaatatcagcaatatcaaggaaaggttaaacaccaacttactgaaaaagataagcaactgcaacatggaacccaaaggtgtttttatatttgtaaccctgactccaaattggtcattcccaaaatctgggctctctgttggttagacattagtggtcttctcattccaagaagtgaacaataatgtaaagctcgtcagattttgggaaatgagagaggtgaaaataaaagaaactagaaagggatgcctgtgtctgattattaactttgtaccatagaggaagaagattaggaatatttagtaatgtgggaattcctttcatgatttcatcacattttattcatgaaactattaatatatttattttaaaccgtaattcaaaatgtattagatccactctgtaacaggaatcacgctgatgttgagttaaacaagaggtaaacaacagatgttttcagggtcccaccctgactttcttgtgctaggctgtttcagggcacaccagctcaacttctgaatgccctcccacacctcctcacctaaggctgtgtctgggctcagagcaagctccgccagcatgcagaccagatacgctaggaacagctgcagacaaagactgacttgaacacccttaacccccctccagcgaggagttctgaggtgtgtgtgcttcacgctagctccctgagtgccccgtggagaggaagcttaggttgcctatggtaaataattcaccctttactgtattccttctacaccctgtcctacttcccttcctacctaccacattcttggatcacttcctaagtaaactgctcacactcaaagccttcacttggatcaggttctgaaggtgtctgatctttgatgggcaatctctatttgttgaaatctgtgtttcaaagcagcaaatatcaacttatgtagcaatatgcagacatatcaacatctcgtgctcagaggtttcatgttgtttgttccaaatggaatgggatagaaaactttaggtagacccccaggaatgacctgtgaaggtaacttactatgtgcaaagatgcagtcccacattctaaataaagagacaaaaagtagaaatgagcactaggcattaatctattaaactattatgcatctttaatttcaaagccaatttcccatctcaagtaccaggaagaaatacagtatttaagtaggcaaatataaaaattatccaaaactcttaaaaaattaatgattttgcccatcctatatttatgcattttttctgggaggggtaagagttagcaataaaaatactcagaaatggtattccccaggaaaaggaaaagcatgaaactaatttactaatctatgaataacttagaattttctataaaaatagttaatgttgagttaggtctaagttatgggaaaataaatgagttaagaagaaattaaatagtagtcaatccattttgccaaacacggactaattttgtgttttaaaataactataaagaagataaggacaagaagtttggcttttccatgaaaatcagttttatagtccatgaatcctatgcagtgagcctaaactaactggaactcattttacctatttttgctgtttaattttacttttatttgctgagatattcatggtagatgaaaaaaataaaaataaaaacccttcctgctttccttgacccagccttaagttatcaacactgtctctctacccaaaccaaatacactagataattgcttactccttgcacagactactaccttggaagtggtgactgttttttaaaagtaattttaaaccactggaagactggcacagtttcaattctggagcaaacagggataaatgggcatttattgaatgaaaatgcaccattttttgaaacaccacggtcattgcagttattatgaaaatgttgttctatctctcacgttgacaaatacacctgatatggtttggctgtgtccccaccgaaatctcaacttgaattgtatctcccagaattcccacatgttgtgggagggacccagggggaggtaattgaatcatgggggcaggtctttctcgtgctattctcgtgatagtgaataagtctcatgagatctgatgggtttatcaggggtttctgcttttgcttcttcctcattttctcttgctgccaccatgtaagaagagtcttttgcctcccaccatgattctgaggcctccccagccatgtggaactctaagtccaattaagccttttttgttcccagttttgggtatgtctttatcagcagcatgaaaacagactaatacaacacccaaaatttacatttccatatgtctcaatttgaggtgcatcccagatgttagttcttgcagtcttacaaaccaaaaatgtaagcactgaattcatagtagattccattatgttttccgtaaagatgcatcacagaattatgggagtttaacaaatcagtaaaacggtggaagacactccctccaggatatgtctaaaggagacttaaccagtacactaacaagatgctgccacatctttccctacctttctcaagctcatcaaatgtagaaaagagcctcactgcgaaaaaatgtctttaacaacttttttgaaatatgtaacttccataccataaaattgtctcatcttaagtgctcactgacattcttatatttactgtgttgtgtaactatcaccatcactgggttctagaatgagtccatcaacccaaaaagattgatccttcatcccttactgagaaaatttaaaggtagaaacaacaacacaacattttctgtctttaccttctctttttattactcttgtttcatttcctcatatattgaacaaggatttgttgggcagctactatgtgtcaggtactgttctaggcagtgggaataagaagtaaaaaagaaaacacatctggtcttatgaaacacagaaacagacacacacattcatcctaattgagtgcaaggagaaacagtgcacaagattaacaagcaaaatactaaggcagggtagacagtcataacagaaaataagaacaaaaatacaacacgggcaacgtggatttgtttgcttgtttgcttacacatataagtagcatggctaaagatggttttgctggaatagagatatttgtataaagaaggtgagccagccagcctttcaacaatctgaaggaagagcatatccccggtccaggaccaggtaaatgccaatatcctgaagcaagggaaagattatagtattcagagaacacagaggagcctagcatgttgagcaggaaaacagggagggtagtgatgaagtctaagaggaaggagaaagggggggtcaactgggtcttaaaatccattgtaaagaacatggcttctactctgaatcagatgggggaagctgctgggacactttgagcaaaaaactgtcgggaagtggctcagattttagaaggatcactcaggtggctgcgttgagagaggactaaaaaggaggggatccagaagtggaaatccggaagcagggatgagaggcctgggtctgaaacccaggatccggaagtggggatccgaaagcaggaatgaggggccaggatcaggaaacaggaatccagaagccttaaggcagaagccaggaggcagaagtggggatgtgattaggaagctaatacaattcccagttaaagacagaactgagcggattaggggaaacacagggaaaggtgaatcaaggcagatctgaggatttgcggtggcttgcagaaaatgtttagagtggagaatgactgcaggcctcttttgccacaaactgctgcaagagcagcattgccgattactcaaatggaggctattgagagaaagagtgcttaagggaaaagtccttaatttccttggggatgctcgtatttccagaaagagagtaatcatttgtcgatcactgtgactgctatgcttttggcctttttttttttttttcccaaataggcttttttctaaggaatagatcaagtaccaagctacaggatactcccacgctataggactgcagttcagatacatgggtaataaaagaggcaaaagacacagaattaactttatttctacctttaaattttcctggtaagccatgaaggatcttatcggggtgatgcactcattctaaaactagatgatggtgatggttgcacaagtcagtaaatactaaaaatcactcaactgtacacttaaaataagtgatttttatggtatagaaattatatttcaataaagttctttaaaacatttttcccagtgaggctgttttcaacgtttggtgagaatgagaaaagtgtggaaggatgttgtcccaccttgttagtgattaaatctgctttaaagatatcatagagggaatgtctaccaccctttggctgatatgttaaactcccgtcattctaggactcatcttcactgaaaatataatggaatcttccatgaattctgtacagacatttttggtttgtaaaattgcaagaactaaagtttgggatgctcctcacaatgagacatatgcaatgtgaattttgggtatatttgtaacagtgacagaacaacattttaatgaaaactgcaatagttgcattttcattcaataaaagtccacttaaatttgggagatgcagcttccattctagattataagttgctccgatatactaggaagtgtcaggacagcttggccttcctactttcagttagcaccctcatgaccctggggctgtcacaggatttctgcccagatcctgaggatcttgtgatagtaaggctctgtaacaaatcatgagagcaaaaccaccttggtcacctccactaggcaggaggtgccactgcaactcttacaggaaattaattcagcatctgtctctagaggctgagaaccacttctgtctgaggtctgattttgcagtcttattcacagagcaccagcccaaatcctgcaggcaactgaacagatggtaatatattttgaccagaacatctctggatcgcatttgaaccatgaaactcaaggtgaagcattctgaggctttttattgataactacctcctaacccacaattaattatttatttcacttgcctctctaaattttcaaatcacttggagacagagtcttaagacaaggtttgatgtctttatttacaatttcactttaaagtttgcttagttcatgaatttgcctccctgaggagaaaaaaaaagtgttttgtttgtttgtttgtttgtttttaaaaaaaagaggcttttaaatgtaaggttacagtatttgttaatgtcccaataaataaatttacttaaaataaaataaatttaaattagcttctgtgtaagaagatgacttgttattagtaagagactaatgtaactaatctgtatttatgaaaccagatccttataattagtcaagcagatgtctaattaatttggaaggtacacagccatatggatgcaactagaaaaataaacttgaagatattattaatagctggtcaaattatgtccttcaaccgtcacagattaaccacaaatgtaacacactgttgatctgattacacagaggttttaaaatatcaaggcagtcagaactgaacaaaattatagcaatgattaaatgactcaggaggggtttaaattctagatgttatgaagcaaacgtaggagtcaaattcactttcaatttaacaatcatttcaagaaaggctattttgtctagaatagctaaaattcagtctttctctttgaaaatcaattgaatggtgtttgatacagaatatcttaaagcaaaaactcaacagatgttgataatgaaaacccccccgccacttcaaagtttaaaaaaactcccttatgttatcttctatgatatactgcaggtaaaattccaattttgtccttagccataaatgtacatggtaccttcaaacacatctggtcccattctctaaaacagcaaagccacctgttgactaactataaatatgaacatagagacagtgaatctgcattccatgtgtgcctggtagcaaggatagtattctgtgtctgggaagaaaaggaagactgacctttggaagaacggaagtgtttgctgggggcagtgaagcctcgagttccatgcacattcacagcagccactcgaaactggtaccatcggctgggtcttatgtcagtcagttgaactcgctcgtctgtggtctgaggggacatgtcacagagcacagggaacatgtcactttttattccgacatgttagttggatctgtttagaaaaatacactaacccatcagccaatgcaactcagtctgtcttccccctgataagaggggcttatcatgcccagttatgaagagagctgtcagggaacaaagaaccactgatatttcaccccaaagaattaaacatctcttgaagtcaaaaccttatgacaagagcttgggctatttttaaatctggtgactaattacagcatttgagatattcaatcaatagagaatatttatgtatagtaattgttacattacagcaagaagatgaaatcatcttcagattatagaaagaaaatgtctttttaactcacatgccaaatataactgtaaaataggtataacaacccacatgcaacccactagcaatttctggaagtaaagtataacccaagccactgtttaaaaatctcttgagtaagtcacataacatctatgaagaaccagtcctgatctaaaagggtgagatgtgttagcatatatttgctcaataaaatgcccaaaaggaaaaaaatagacactggggaagatcagaaggttttgctgtctctagtgctacaattttaagatatcaaataactttaacagtcttcatactatatacctgctttcaacaatgttctgtgttttgtttccattggtagatctgaaaacctttgccttgaattccaagaaataaccatctacagtctatgccctcatctacaccaggtgccgaactcaacttggatctgtggatgaaactaaggaaacaggattggatttgaacactcccaaacttcagattataataacctcagcttaaaataacttaatgtgaaaatgactgtcacgtttacatcaatatctaaaagaagctgaacatttctgagatcaaaggaagaatatgaactcttacatgtggctttctacctgatttggcagactttgagaaaacactttcaacttcatcatttagagtttcagctgcgaatttaaaaagcttaaagtcagcatggtatccacagcgtttagcagagaaggaagtactacatgtagcactaacagtaaaaaataataccagcaacaataataaaagagcttttcactttccaaaaatcttttggagataaaagagatggtcttattgctggttactttcataattctttaagtaatttggaaaaattacaaatgaatctgtaccacgatttatgaaagcatgccgtgtaaatcaaatggaatttcaggctgtattctgattagctttatgttttactgaagcaaattttttttatataaaatataggtatagaatagaattactaaatttatttgaccaggttttttttttttctaatttaatgttgtgtttttacatcaaacttcttatttattttggggtctttacattgttttattttagtgcttaacccctttgagatactgctatttagaagatattcttcttccaaacacctaaatattgacatttattttacatttactgaaaaaaaaaaaaataggaatctagtccttggaaaaaatgatctaatcaacataaggtgagattttttttcctatagacatagatgtggagaaggcattttagttgtctaaaggcatgaaacagtttcacattcagaatctgttactttttatatccatgtagggtttgtgtgtgtgtgtgggggggtggttagcagctggtactggatttaacagctcttaaaaagaaagaaaatattttgcttttctcatcaacaagacagaagaggaggaagcactctctgggagtgttgccatgcaggtggtatatcagtttttaagttgactaagacaaagaagaaagtacttagtgaagatttatgggctgctggctatgtcccactaagtaattttgtgatacaaatcttatgccatgctcctaaagtctgtgggtggaataaaggtgtaaatgcaggagaaacagaagagaaggcatttagattattaaatgtcaaattagtccttataatgttgcatttcccttcctctagttggctttgagtttagctgaggaaaatgtggttcttggagaaaatacatgtgaataatcaggttataaaattatctcccttccatgtgtatttgaacaaattaagccaatggtcgagtttccgagcacattcgtttgtatctatgaacctcatcctctctttagaagaccccatgatgttcatttcatatctgagtaatttatttctgtagtcaagctattttgaggcatagcaagttaattttttgtgcgtagctatgtagcagacactacctccaggatgaaaatcaaagtctatatgaggttcttacctgggccactgtctgccagtgagtggcgtcatcttcgctaggatggattccataattccatcttctttgtaccacatagatcacaggctcaatagaaatattgaatttcgaggaccacttaacctccagctgtccagactgcagttctgtaaatcgtaactcttttctgggcttcagggggacacctgaaacaggaccgtatcaattaaaacaatctgcgtgtgactcaaattgaagtaaaagttgaggaagaacaaatatggaagagatgaatctgatctgatgacaactgagatttcctttcataaaagtggcctctccatacagggtttcacatctgaagtcttctgacactcagttcagctatttgctcctttttcttttaacttgtcttttttttcttttttttaataagacagtctaaattggttcctgattctgtaacaagtggcttattccctagtaatctctagagcaatcatttcatgtgcattcttttcaataaatcatgttacaaggttgtttcatttgaggttaacatggaattcacactaggagatcattataaagagtttcaagtcattttcccattttttatcatgctctgtgtctattgatatatcctaaggtcattataacatggtttccagatttgatcttccttctttctcagggagtttttcatttaaggaaaacactgcaaagcaaaatctcttcatgtgaaatctcctaagagtgatttccaaagttcaagtcttttggattccgcaatcaattgctcaagcattcccctatatatagtcttaatggcttaacattggaaaataatgaatttataatgtttggttttggcatgagtgagtgtgctgcttcaaaagtttctcacaggtgtttcattttaaagtagttaatcattctgatttctttatcgccttctgtacatgcaagttgtctggcaactgatacattgaagaaccacagttcaaaatagcaggcatttcagaaagggaatttgtaaagaaatttgtaatactaatagaatatgcaaaactaactgaatgaaatagaatctatggctccatgatggtgaatgccatcaacaccaagaacaccaattaccattaatagcattttctgtacacaatggtcgtttgctgaaagcattgaaaactcatttcaaaagctagttaagaatgctctatttcttcttccattttgtaagtttaaacacagaagaaactggaaaatgtgcaaacaccaaatgcaaataaggtttgatgcatgttgacatggttgaatttcaactcctatttcattttgatcttaattcatggtaagtcttgtttacgaaaattttaaagtcatcaaatatttggatggatggaattgaataatttttttaaagcatatttatatatggtcaaaagtcattaatctaaaaaaagctattttctggagaaaatgtttaccatacctattgcagtctcctttattactgatgggtcatggctgagtagtgacctttagtttacaataaatttgtctcatctgatcctcactgtgagtttgtgaagtgggtaaagggttaattatctacatgttgaataggagataactgaatctaaggaatattaaattagttgcctgggactacaatctgatctcaggtttctctctgaattatctgctgctttctacatttcatattagaaaaggccacatagagagatagagaaaagagatggttttgatagatatgcaaatcccttggacattcttattctaagatcctcagctttcctggtggatctggaacttcaccaagtcagtctttgactcctgttctgccatgacatgcatttatttcaagcttgtattgtaaacttttcatctcagtgcataaccatagcaatgggggtacctagacttggatgattagcatactgctgctaagcaaatgtttttccagtctatctctaatccctggctaagctgcagaccatcttttccacctgcctgctgaatttctctgtcccagatatgccccttctcctgggatatctatctttatgacaactttattctttaggatgtctaagggatcttagaacctttttgatatgttcttgcagctaacaacatttagttgtcttactgcatagtacattttcaagaattatcaaatcattttgtctccatgatggccacctgactttactcccttccttgttcccaacctatttccctgcatctcaatctctttttctactgtccccttattggtactttggggttatttttctaacgtagaagcgaggttctctccttcagtttcccaaactctttaattgcatcccattctctatagaatgaagggaaacttcttggcatccccttcaaggcatccttcttcataattggctaccatttatttgtcaatctatctcctggtacatctttaattttttgtcacagatattatctttaaacccagctttcctacaaatacactgccaggtccttaataataccatggcctgtttatggtttttttgtttgtttgtttgtttgttttcattctgaaatgtcttgccttctgctttctaactgtaggcccttgaatatttccaggctcggaccaaatgccacccctctgtgacacttcccctaaacttctcaattggaaataaaggctttattcttttgccccccttcaatgttgagcctgtaactgtcaagacatgcatttaactgcctcttgctgcagcaaattcatttaatgatgcctgtctttccattaagccacagcccccagaggtcaaaaaccatgtctccttcattcccgcacctcacaatgtcccagaagagaacattctgcaatagcaaatgttcaatgaacagtcaatgtttgctgaactaatagccaaacccactttcttattcttcactcaagaatatgtctgtggaaataagagactagtgcaacatttatgcaaaccactgcaacaatggtaatccctactctgtttgaaagtcacctagggaagggtgaagatttatcataagtattctgtactgccatctttatcatatattgtttcaagcaactcagatctcttttccagcatggtcttattactcacatgtacattcactctgttttttaaaaagataaataccagaaaataaagcaatgccaaaatgtttacaagatagaacgtttttattacactgaccataggactttcccattaaaaagaaaaaaaagaccaattcctgatcggagagaaaacccaaagttaattgattttaatagaagcagctctgtatgttttgtgtcaagaaaaaagccaccaaaatttgttcagagtgatgaaaaaccaatctcaacaaggtgatcatttagtatcattcttgcattgaagggtggcctgcatatgccagacaaatagttctaccgaaggggataaggcgagggagagtagccgcagagaacatttcatgatttacttgattccttggtgcatagtaaaaaaaaatgatgaccaattcttcaaactcatagagcacattctccgagacttctgaatctacctttctctttggctttccaatgtataatcttctagagtaaatatagctacagtaaatagcctccgaagtgacctgaactcaccagaagccaatccaagcagcccagtgccctcgctgtaaggttttaatcttgaatagcattcaaggaccaacagccttaatcaaatgtaatgagcatcagggcgatgtcagttcaaatttcttcatttaaaaatctctttaattatgatgaagcatgaccctgcaatttgcatgttaagaaatggtccatctgctttccattaaagtcagttggctcctttgattggaagtaactccagcgctctactgtaattgtgtgcagatggggctcaacccccctcaagacctccagccctcactgccggggcgcacagtcctcactggctgaaccagcatcccaactgcataaccagatgtatagactggatctcttctcaatgtgttttttattatgtaaatgattagcatttttctctttaaaattacttttgaacaaattagtcatctgaaatctaaatgattctgttgaaaaatttacaaacgttatcgtatggcaaactgcaatatgtgacgtccagtttttttctttgaaatgcaagaaacattctgctgaaatcaaaggaacagaaacccaatgctttttaaaaatgttgaaaatatatggatagaaaaatcaattaggataagcaatctacagttgcatactcattgtgagattttattactattaatttttatcatgaatctaaatgatataaaaatgtagcaagatgtattgttctagtgatttaatcactacttgatatctctcataaaggtaattagaactctagaatttgtatttacatcacattaaggcattgggctactggatgcaaaatgttgaaaatttatttgtgagaagttgtataaatctatttccagaggtctgaagtttcactatttgatatattaattatttgtggaaatattaaattaactctatgatcgggtctttttgaaaagaaacagactgaagtacaattaattcttggtttatccatggcaaaaggaaactataggtcacaaattagtctgaatctttacgtttgtaaaattttttaacttttctttctccctgcccaaaccatttttgctacagttggaagccaagagaggcagtgggatttggcaacaaaatagtaaaatatatcaccctctggaggaaagattgtctcaccaagccataaaatagacttagagaggaaatagaaatagaaaggaaaaaggaagtgagtgcccccaaatgcactcatttgtattctacctgtagactttctacaactatatgaagttttgcatttcatagaactagtaccagcaggcatctccaatcatgttaatatttccaagccttcattttgatgctaataattttatttaaaaagtaaaagaaaggatctctgctgtttgttttaaactatagtctatgaaggttaacttacttccaggcatcagttaagtgcagttcttacagcatagcccaaaatcatattttcaagacacccatcgcttttaaaaactcaagtgaccagtataaaaagctcttgaagctataaaaccagtactttctatcttcccttccacaaacacagcagaccaaacagaaagtatgtatgagtttttataatttaaaaatatttttaaaaattaattcattaagtaataaaatgaaatatatacagaggttggtaaatgtccatttatttaaaggttagaaaaacaatttgcccacttaaagagtattgtgagcatgacaatctcagtaataaactactggaccatgtggggggttagtgtcacatggatccttgcaccccaatgcccattatagatgacagcaaatagtaggcactccgtaaatgtgtattcaactgaaatgtgtcaatacttctccatccaagtgacagcagccccttgtaaaggtaaaccggggaaatgttaagaaaatgttatttcggatttccaaacagcactatgcaacactttaatacataaaaaatgaatgaatgaggaacttcaggttttcaatatttatcccatagaatgtggttctccatatagcacactctgtatctagttttatacgcttcaactctacaatgtaaaacaatcccatgttattcattagcctaaaatgattcataaagtagtgattttgttggattaaaaatattctatattgacaaatcttttagttggcctattagatagacaggtggataacagatttagatacattttgggacagggtctcactctgttgcccagactggagtgcagtggcatgatcatggctcattgtaacctcgaattcctgtgctcaaatgatcctcccacctcagcctcccaagtagctatgactacaggcacatgccaccatgcctagctaattttattatgtttgtagagatagggatatcttgccatcttgcccaggctactcttgaactcctgcctcagcctcccaaagtgctgggattaaaggggtgagccactgtgtcagaccttagttagcctattatatcataacacaaccatgcccagtgagtgtttccattagagatccatacattcaaaataaaaatgacaggagagctagcccagatgggagcagatgttagatctatttctgctacctactaccaaatcacttaggcatagcctgcaacctctgtttcagcagctgtgaacagagagcaggactagataatctcaacccaccatgactcccactcttattaaagaaaaaaactacacagacctagcagagacagagagagggaggcaatcttatttcacattagtttggggcaataagaaggcatcttggaggtaggaaagacagtgatcacgagtatcctaagattgcaggttggtttgtgcgctgactgggcacatggttttctccttgcaaagccaagggatgggttagaacggacactttccctggggcttgtgtacatcagtccccctctcctcttttgagagtgaagaagcagctggactccaggttgggaatgccaaaagggacttcaaatgcctcattagctaagatgatgaaggagttgctgtaggctctatttgccctccttttacacacactaacatattaagaggcactgtcaaagctcccaggacatgaaaaccagccttcctggagggactactgaagaaagcaagaaaaaaaatctacatatatatatatgtgtatatatatatatatatatatatatatatatatatatatacacatatatatacacatatatatatctacatatatatgtgtatatatatatacatatatatatatatattttttttttgcaaaataacaatctattaacttgactgtcttcattacacaaaagtcactgtcaggttaacagagtctgtttattctatttgtagttgattcccattgattctctctctctccacaaaaatctaagttaagagctaatttgtagtagaagagtgacttcagtactttaacaaaagttcacctggtttcgttaaacgtagttttacattgaaagtgtctttgtatacttaatcatttattctggcccgttctacaatattccccttattctcaagtgaaacaggcatatttgaaattcatattaactcttcagtccttttataaaagtgcatattttaatttatattatctctttaaaacactataggttttacaaaagggtttaaaaagacgattcccaaagcatcctatttttatggtgaatgctactcatacatagcatattatctttaatgacagataagatttcataataacagatgctttaaaagttagatggttttaaatttcgcaaaagtgacttgctgtaatttaaaataagaggcatgaccacaataaaactttaaaactattaaagaaacatcacttggtaagaagagaaaagcattgattattttgaatgtaagacataggacttatggtgtgtttccaacgataaagaaaaaaaaaccggttgaattacatagatttcagaggaaagtattcccaagtgggagctaaaggaagatgggacagatacttaacttctgggagatgtgaattgttgtaagtgttagagtaacatggacttccaaaaataggcagccagcacataaatcaaaactggcattgatggtgaatacttctttatacacattttttttaagtaccagtatttagaaataatatggatttggcatgtgtatgtgaaagacatagagagagaaagacatctgttactctctctgtactttaatgaatactgcctactgactgactctatattaggggtccccagctcccgggccactgactggtagcagtctgtggcctgttaggaactgggtcacacagcaggaggtaagtggtgggtgagtggacaaagcttcaactgtatttacagccactcctcatcactcacattaccacctgaacctcctgtcagatcatcagcagctttagattctcataggagcatgaaccctattgtgaattacacgtgagggatctaggttgcatgctctttatgagaatccaatgcctgatgatctgtcactgtctcccatcacccccagatgggaccatccagttgcaggaaaacaagcccagggttcctaccgattctacgtgacggtgagttgtataattatttcattacatattacaatgttataataatagaaataaagtgcacaataaatgtaatgtgcttgaatcatcccaaaaccatcccctgccccctcccccaacatggaaaaattatcttccatgaaaccagtccctgttgccaaaaaggttggggactgctgctctatataactcttcaatgagacccccaaaattaacaaaatgttatatgtcacggtgtattttgatggtatcccaaactatacctaatacaatggattcatcttggctttaaaagagcttagtcccatttacagaaaatgatcagcagcactcgatattaaggagctaagtgctctagaaacggcttttgaatataaactattgcatttgctaaaccgtttgataaactgaacctccatgttttgaggaagggaaatcctttgtctagaatctcaaggtactaatgaaaatatttaagatctgtacaacgacactaatgttcttgggtcatatcggcagaaaaagcacaataccagtatatttgttatgcatttttcaagtgtgcttcatctcccagcctattttctaaggatttaaatcgatttattccagtgtacctagtagagcttacttgaatcagtctgactgaagaaaaagacaaaaatgttcctgaattgttgctgtccatcacatatgtcaaattaaaaagaattaatatgaatgacttgctctgccccatgtcgagttaatatggctaatctttatgggtctgtgattatgttaagatgtctgtatgtggtataaaataaattttctaaagattttatgttttttagacttttcacacctatgatggacacccttccctaggcacacacagatatatgtgacactgcatgtgtcttcacacccccagtgctgccccttacctttgtacagagtcttgggtacttgacaggtgtgtccacacccattcgaacaacatttcttcaccccagagcactcattgtcaacttcgcagctttcaacacaggcggccgcaaatccactggctttctcaggagccggacagtccccctgcttcaccaacaggatgtatttgaggaactcacagctggtcaagcattcgtagctcttcttggggaagagaggctaagtcaaagaagaattttaaaaaatattccattaaagacacatgaagtctgatttccaagacatctgaaaggaagttcaacatttttccccaccaaacctttgtttgaatatttgacaaaatgcatgtatttgttttcttttctcctatccaagtgacattttgtgctgatttctcaaaggaacataatccataagtgatgattttatattgcatgcaacagacaaacaccatgtatatgcgcccacgttcacagatcatatattctatcttggtcaaagatgttttccaaaaaaactgattatagtcacaaaacctgttcagtacaatttgagggccctttttggattatatacattacacttataacacatcactctctttaattttttctttctccctttttttttttttttttttttttttttttacagttaaggtctcactttgtcaccccaggctggagtgcagtggtgcaatcacagttcactgaagccttgaactcccaacctcaggcaatcctcctgcctcagcctcccaagtaactagaactacagacacacaccaccatccctggctaatttttattttttgtagaaatgaggtcttgctatgttgtccagggtggtattaagtcctggcctccagcaaatctcccactctaagcctcccaaagcactgggattgcaggcatgagccattgcacctggctattttctcatatatcataaatactcatcaaaatagcaggagctctataaaactttacaattctcacaatggtaacatatttattggtattgtatagcacagttgtctaagcgttctaattgaacatatttcaataatttccagcctttattattaatatggaattgtcaatgagttctgcagtagaagaatgtgaatcttctttaaaaatcagcccacacctatgttatctgtgacacagttggggtctgaacagcatcttgctgaggacattttggttgagcccagaatcaatcaaccattagtgagaataggaagccctggacttattagaggaatgcattattgaaaaagcctgagtaatgtgaaagagccatttatcaaatgcctatttttccttaggaaaaaatggttcaggacagcactcggtcatccctaagacaggagctgcaattggaagataatggctcttttctgccactgaacagaggagttgctgagatttctaaaagctgtcccatccagggaaagaaagggaaggatgctctctgtgctcttgctctcctttttcctatggaagagaatggccaagacagccccaccagccccagccctccacccagccctatccctaaccctctttttgctttatagaagatggctgaaaagatgatcaccataaccctaacttttataccaagcctccttttatccttatgggagatggtttccatgataactactattccattaaagacacatgaagtctgcttgaatgtttaacaaaatagatgtatttgttttcttttctcctatcaaagtgacattttcttttatcaaaatgcattttcacctggaatgcctgtgcatagccaggttaaatttcactgtctcttttacctgggggtggctacgttgttgtgaatggaacgtaatcagcaaagttctgtgccactgtggaccgaggcttgcagatggtgggggatggtgcccccgtgttcttctttattagctggatatgggtggcaccacagctgtagggaatgagggaatggtggggccacaggaggagagacgccagaatgctgtctgcccatatggagaaggacagcaccctgccgggaacagctgccttgaactgcttcatgggtataaagcaagtacacacgtgtttgaactcttgtacatgtcaagctccgtttgctacaaccattcagggtacctgaaccaatgcaaaggccatccagtgaagggctgccatggttcctcaacgttggaagtggaagatgaacaaggaggacactttctgtttatttgatgtcacaacagggttaggaatataagaaataaatgtggtagctttggtgaacagaagtctagggggagaataggaacatcaagcagctcagtgccagcatgctgcttgatgctccacagtgatccctaaccagggctcattactggtaacatctggaaacacctgggttacacctggacgatacctgggaacactcgcctgtgtgctgcctgctgctcctccctgatgactaaatatggctctgcaccatcgtgacacctgggtaacaccgggtcatccctaccattgcctggtaatgcctgggcaacacctggtaagaccagctcatgtgttgctgttgcttctcaatagtgattgaatatggctccctaccacgaggtaacacctgccaaacctgccagcatgctgctggctactcctcactgttaaacaaccatgaccctttagtcagataggtgtctggtagcacctagataccctggagataggaggttatctaggcaggagactgaatggtttgggctattaaccagagagtatttcaccaatagtggaggtatgttataaaacaaacaaacaaacaaacaaaaccaccattatcaaagtctctagtgggaggtggaaggttggtgggaggaatgtctctcttttccggcagttagttcattaattttagcctatgattctcagattgatgatgactggaaattccactgaagactcaaaacataacttcagcaaggaatatcttagtaatcctagaataaactacaatttcaacgtaaatgattctccactgtctcacctgcttcttttccccaaacaatgttcaattaaaatatgcgtaagagttgacggcaaatgttatattatgtgcattttaccacaattttaaaaaaacactgtgaaagagacagaaaatttttataccatgagaatgtgtgcagcaccaaattgttattgtttcatagtgacaataatctttctgatattgtaaatttagtggatgacaaagcattagtacttcattacaagttaaatacaattaaatgcctgttcttttcttaattaacaaaaggaaaacagtggaaacactagctagaaaaactataatttcaaggtttgaattagaattgtagatgtcatataaaattgtttgttagtaattaatcatacataaaacgtgaaaataacatgagttgactgaactaaaattatttctcaatttaagaactttaaggtaaaacttagaagggccatggtgtcaatattgaattatgacaaatttacagctaatttaattaaaaagaaactttataagtatttaaagcattattaactctcaaggcttttatctcttactctatttcacagtccatttttctgttagctgttagatgtgttttacttcattgagttttgaagctctaagtttagtttcaaacctaagttaataatcaaagaagtatgctaacagatctgtaacaattatgtagtatttgccaactttcttctttcaacaattcatatacattacacacactgaaagaaaatacttagttaccaaaatcattggccagtgcctcatgggctgagatttccaagtagaaatacttgtattaggccgggcgtggtggctcacgcctgtaatcccagcactttgggaggccgaggcaggtggatcacgaggtcaggagatcgagaccatcctggctaacacagtgaaaccctgtctctacttaaaaaaatacaaaaaattagccgggcatggtggcaggtgcctgtagtcccagctacttgggaggctgaggcaggagaatggcatgaacctgggaggcggagcttgcagtgagccgagatcgcaccactgcactccagcctgggcaaccaaagcgagactttgtctcaaaaaaaaaaaaaaaaaaaaagaaatacttgtattaaatctggcaagtgtttcctgcttggtaacttggaaatcacagtgacttagtttgcatcatgatataatgaaatcaactcagttcatactcttcatctatgaaaacagagtatgagtcaagaatcagataaagtttggatcctgtattcgtatattattctaattatctatatgccaactgccacacatttgaactgtgagggacaggaaaacagaggctatgtctccttatcttcattatttactgaactattggggcagacataaaaacaaataaacaaagacagtaacctagaacagttatgaagcatgtgttcccaatgactataaaaggggaatgatcataattagcccaacaatttagatctttcagttgatatgagagttattctgtatggatattcaatgttttcctttttggtaaggacatagaaacacatatgttcatctttgcacccatggtttctagactggtttataatcttgaaataatacaggtaacattatgaatattacatgaggtaacacacacaaagaattaagcactattgtgcatagttggcccacaatacatactcaataagaattaagtaatttgtgtctttttttcttttatcactgctacaagtttactctttaacatttcaaaattcttctggtgtgctcatgaaaattttgtaagatccaaagacagaaggaagtctgtattcttctacagtgtgtccagccactagattccaacccactacttccagattaagcactgaaatctgcatctcaggaattgtaccctgtacttaaatgaagttcatcttagagcagtgtggatttggtgcaacagtcttacagaggagctttatttaactgttctattaaaggcagatttatcaaagggaggttttgatgctgtctattaattttctttcataattctcttggattgggttgaaaaaatattatttgtttgaatataaattagagaacatatggtatgtgtacataaggtctctctccaggtcattaataatagtttaatgagaatttattgattgaatggaataaggagaaaaatgtgtacaggtcagagaaaatgctgtgtgaatattaatactctagatataaacaaaatgtgcaaattggtctccagtaggaaatcctgtgaacaaaggtaatttgagtgtcacaaaagtataataatttctgaccattaagcatgtaaaatttcatgtgataatacaaattactcagagatttgttaaaaggaatgagaaaataatagaaaaagacttattcaaatcagtatgcatgtaatacccatcaattttatggtcaataaacacgtgtgacaacatagattctatgttctatttcctgtttctaaaattatatgcaggtaatgaaggcaaattgttaactgtaaatttagtttttataactacaattcatttttataaaactattcatatgattaatttcacgaatcacacaaatgtcactctcaaattattattattattattattattattttgagagagtctcactctgtcgccaggctagagtacacttgcatgatctcggctcactgcaacctccaactccctggctcaagcgattcccctgcctcggcctcccaagtagctgggattacaggcatgcgccaccatgtccagctaatttttgtatttttagtagagatggggtttcatcatgttggccaggatggtcttgatctcctgacctcaagtgatctgcctgccttggcctcccaaagtgctgggattacaggcgtgagccaccgcacccagccaaatgtcattcttttgccaggtcattggctccaatttaaaatttgaaaagaatatggtcactatgcccattaattttgtttattttgcccttactgtccccaaaactaagaaagaattagtctgcaaagattatgtattttttctagattagtgattaatagtatctaatggatgtcattatgcctccaaagaagagataaagcaaagtgttaaagaaaaatatctttgaggtgcattggattaagtaaaaaatccttcatatgttaacgaatagatatatgtcatactatatattaatatgcagtattaatgaattctcatatatcccttctacatgtcatctcctaagagctaaaaactaaaatgtggtttttagtgacttacctgggtaatatgctaagctccactaagaagaaaatgaataaaacattaatttatccacctgtggcaagtagctaaaaataaaattaaatactaacaaaagtaggcaacatttcttgaatgctttcagaaagagagacagtactatctttgtttagtttggtataaaatgcaaggtattgtacagtaaaataatctgttcagcaatcatggaatgataaagacatccaattcagtaaattatcttaatgtgtttaaaatcacataaatacaaggcttcagctatgaggagaacattgcatttggctatttggttcaattcaacagacttgtaccatacgtcaattctctaggattataattgcctttgcaaagagtcagggaatggggggcttcgcttcctgctcctagccaacaactgggattgctgaatacaatgaaacctcaaatatacaatttcctaaagtgagtgctccatcattatcaccactgtcataaccaccaccatcaccatcattaccatcatcattagcagtggcagttggtcaccaagagatgctgatgtctatcacatccctcactctaccccagctgctttactttctcatttcacctattcttccccagtccccacaactgttattatttccattttaaaaatggggaaacaacagctcagggagatcataacatagcccaaatcacaaaacacgtaagagtctgggcaacgatgagagctagtgttttctgagggccccaccatatctcacggtaaaataagaggactgggctcacccagtggctctcagcttgcttccctattagaatttcccagggagcttctaaaactgatgtcttgggtgaacttctgacccgtttcttcagcattccaggcatggaccctggaaactgcactttggaaagaaccgcagatggtcccaatgtctggccaagactagaaatctgctggatgaatagctctctaatttgtgttcagttattagacttcctgattctacatgtttagaaataacctgaatattcaaaaatgcaatcttacacttcctgggaagagatagtggggtgatttcaaatttctttctttttttattccttttctttagcaaacaaatttttaatcttaattctatgctgagtagttgaatagctccatctacccagatacagaaaagctaaatgcatttataaacagaaaatctaagtgtacataaactcctagagaccactgagggtaactaaattaaagtactccaaactataatccaggggttactgaaaatctgattctgatacatccgtctctgtatgtacaaaagatatatttcaggatgctcaaaattaaagcactgacattctaaacaccaagcaatcactgaattaaagtatgttggtaattctttgaacacagtgtctctgaagtcagtgacatcaaaaaaatagcacatgctcttccttttgtattttcactatattaaaaagcaacagtacaaatgctgtggtgttaaaaaggatccttattttttaacaaaggaacttttataaacaattctgtaatgaaaggaaaatagtatgttaatacataaaagtttttgttaaacaagattttacaatttttaaatcagaaaatgttaagattaaatgttaagattaaacaaaaaagcaacctacacaatttccattaaatgtgtctttgtacacatgtcctgggcactttgaaaatgttaaaatcattaaagtttgacttctgccgctgctgcccccatctcagcattgccccctccctaacctggccaaagggtctgattccaaatttctgaaaacttcactcccaaaaaacacagcgagatgaacagaacatgaattcaatacaagagcatgaagacaaggtagtgagacaatgaaatgagatgaaaagggttagaaaagagttaaacaaaaatataaaatgtgaaataagacaaaaacataaagttaagaaataaactagaaatatcaagatcatctgaggtcaggagtttgagaccagcctggccaacatggagaaaccccgtctctcctaaaaatacaaaaattagccgggtgtggtggcagctactcgggaggctcagatgggagaatcccttgaacctgggaggcggaggttgcagtgagccgagattgaaccactgcactctagactgggcgacagaaggagactccatctcaaaaaaaaaaaaaaaaaaggaaaagaaagaaaagaaaagaaagaaagatagatcaaggaattaatagaaaaaaattataaatcaaagggcaggttatgttccaagaataactgaaaagagcaagcaacactggaatatagcttctgcttctgaacaccaaagggaaaactttaatttttcaggcattcaggtaaaaaaggcaagctgattatgaggaagaaaatataattgctaccaaatgtctctctactaaatttagtatgtgaagctaacaaagcaatgtctatataattctaaggaaaataaactctgtgagtgtatgtgccttgtgggggggttgtgttgggggcagggggcatgatgtgccatgcaatggcaaaacctagccatcctatcataaacagaaaacaagaacaaatgggctagtacaatattcggtacccagataaaataaagtaatacttatagaagaaaaaaaagttgtccaatccaagtgtactttagatataactgtaggtaaaatttatcatgcataaacttaaagaaaacaccatccatagacccctgtttaaaaacaaagatatgaattaaatttacaaaattaagcatacagtggaaaaaagaatcagtaaaattaatcatttttctatgtacctaagtatgaaactaaaattaaataaaataagaatgataggagggagaatttgctgtgataaaactaagaattttcaaataataatatgttagaaaaactggtaggtgggaggagtggtggagaaaacctatgagtgtgacttatcttgaacttaatattagaacatcagtaaataataaaacaaatatggaattgaaagagtaacaattccaaccacataatatcttttataatcttttctttataatattttggggtgtctttgtcttctcttgccttcaagtaatattaaactttaagcatttatttgaaactagtgtgcacagagcttccaggtgctggcctcttggccagccatttaagtaggcattgggagagcagtcttggccttgctgtgttaacacgtttctgcacagtaaaccatggctgtttctacatggtaaatctggaatgatggtttggttttacttttctgtgcggtttattaatttttaatgggcatgtatagtttctattaaaaataaatagtatacttggctgggtgtggtggctcacgcctgtaatcccagcactttgggaggccaaggcagacagatcacttgaggtcatgagtttgagaccagcctggccaacatggcaaagcctcacctctactaaaaatccaaaaaatcagccaggtgtggtggcacacaactgtaatcccagctacttggacaactgaggcaggagaatcttcaaactaggagacggaggttgcagtgagccaagattgcacaattgcactccggcctgggcaacagagtgagtgagattccaactcaaaaaagaaaatagggtgtacttttaaaaaatgaggcaaaactgccaagtgtgtctttcaaagaagacatctaaacactaggcatgaaataagaaaaataactctccgttcaaatgttactaatttatgcttggaagtattattataatttgcttggaagcccaattataaatactaatttcttagatgtgattgcaattaattggattcccaggcaaattatagacattggccatggaaaatataaaattaggagaaaagcagaaacacgcatattagagaagtcacttttctacaagtacataccctcttctttcaattacagtaatctttacttatgtttatcttggcttccttcttcctggcctggctcttctatttattttgaaaacaaatgtgtcaccttgtatgagtcagcaacacctcagaatcttgctgcaatatttctggaagatcatgaggcacataaatagctcgagaagttcacaaatccctagagaattagggatagttcaggtaccacatttaaactatgatttatttccctctcctacttctgcatttgttagtagtgaataccaagaatgccaatgcaatgttcagcccactaaaccatttatatactgatttatagaccaaaccggcattctaggtactaggaatttaatggtgaacaggtgaaattgtgaaaatgatgacccactatgcttagtttacatgtttactaacaaacaggtaaaaatcattaaacagtttagtttgcattataataaaggtagacacaggaagttacagatataaggacgagatcaacaaataattagacaaggacaaaactttaaagaccagtcatcaatactgatgatttaggcaagtaaaagtgatgtggaaaacagaagaaaaagagagagggaacagaaacaaatacagcctgtccccttcagagcttgacaaatacacaagcaagataactgctgtacaatttggggggcaaaattaatttggcaagtgtcactttcttcaaaatattaaaggaagataaaatattaccctaagccttaaataaagcttccaaaacacttagcatggatcctagcacataataaaggtgcaatcagtgctagccacctttattagcatcagaattctttaacgcagttctagaaattttacaagaaacaataggaatccatatacattaattatagatggcctaaaatcctcatgtaaataatttcttttaaagaggaacaaattagaaagttgtcaaatacagttgtttactctttgatttatattgttcagtttctttgctcatctcattttgcaaacactgtcaaattctacaaactcatcacatccatccaagatacaagaaaaaaaaatctcatattttacctcttagagatcttccttgaaatttcttatttctttgtttatacactactatattataccacttctggactggttagatcatcacaaaatgaaatagaaactaactgatatgattaggctttgtgtccccaaccaaatctcatcttgaattgtagtccccataatctccatgtgtcaaagaagagaccaggtgggagtaattgaatcatgggggcagtttcccccatgctgttcttgtgatagtgagtgagttctcacgagatctgatggttttataagggactcttcccccttcactaggcacttctccttcctgctgccttgtgaagatgccttgcttccccttcaccttctaccatgattgtaagtttcctgaggtctctccagccatgctgaaaagtgagtcaattaaacctctttcctttataaattacccagtctctggcagttctttatagcagtatgaaaacagaccaatacactaatgtacatagaacatagtttcctcgttatgaacaagtaagagaaagtacaaattccataagttaagggactggttcccaggggacattaggtaatatctggagatatttttgttcctcacaactggaaggtgctattggcatctagtgggtatgatctgagagaccaaaatggatgcccctttatcaactaaggggtatgctaaggttcttggttggcatggcacatttctaaattcctatagctaaacttgttaacaataggagctatcaactctgatttacaacccagacctctacaactctgattggacagaagactggccttataaagattattttctgataagcaactgcagaccacaagccagtttcagctagattatagaggctgtgcacaaattctgtgtcctgtagttcacttttcgatgtaaagagccaaattccacctcatcttaatgctaaaaccctgccccaaagtgaacattgaatgttatgttattacgagggtattttaagaaagttaaccaaagatttagcagaaaaatgtctgagaaagcttcatcagagagcctttctccaccataacaatggccctgctcattcctctcatcaaataacagtaattttgccagagtttcaatgggaaatcattaggcatccaccttacagtcctgatttgtctcctgacttgttcttgtttcctgttcttataagaatctttaggtcgggcatggtggctcatgcctgtaatcccagcactttgggaggccaaggcaggcggatcacgaggtcaggagatcgagaccatcctggctaacacggtgaaaccccatctctactaaaaatacaaaaaattagctgggcgtggtggtgggcgcctgtagtcccagctactcgggaggctgagacaggagaatggtgtgaacccgggaggcggagcttgcagtgagcccagattgtaccactgcactccagcctgggcgacagagcaagactccatctcaaaaaaaaaaaaaaaaaaaaaaaaaaaaacaacaacctttaaagagcacccatttttcttcagtgaataatatttttcaaaacctacattgacatggttaaattcccaggaccctcaattctttagggatggactaagtggctgataacatcacttataaaagtgtcttaagcttgatggagcttatgttgggaaacaaagcttatatgttttatttttggcttttgattccatttttccatgaactttctgaagtcctcttgtgtatgtaaccacgttattcagacattggacaataggtagcacaagacaagaaaacctataaggacacaaatgagatgagctacaattttgccaaaaaaatgatttgacgtagtttcaaatccacagtgcaaggaaggctaatcccaagatagctctgcaatttttccaagttgtggataaagagattaaagcttgaggctgagatggccagatcttgtgggcagactgtaaagcaggatgaaactgcatgaagagagaaacctacagggattcagagggaccctttgatttctggctgaatactgacttgaatgtgcatggcttcaaactgcataagtctggggaaagaataatcagacagcaataaaggaaaccattctagcaaaaactcacatttcaaccagtcagagtgcagagaatgcacaattcatgaagcattggctagagtcctcagaaggatatcacctagtaatgggataaattgggcctagtctaaaggctactactctgaacccgcccccaagaaagcttaaaagaaacttttaaaaataagaaaatgaatctcaaaaggaacttaactacatgccagaacaaagtctaacactttctggaaagatacagcaaaattcaaaacacaaaaatttgacatccaatcaaaaataatccagtgtgcaaagaagcaggaaattgcggcacataaaatgggaaaaaagggatctacagaagcaggaccagaaattatagaaatgatagcattaacagcaaaggacatttaagaactaatataaatatgctccatatgcccaggaatgtagaggaaaacatggacatagggaggacaggaatgaaagctacagaacagagctgcatagaaattccagaagtaaaaaggaagaaatgaaaaatatgtcaaataggatttttaaaatgttagacaccatagaagataagattacttaaaaggaaagcaaagacacaatgatttaaaataaataaataaataaataaactattaaaatgaagcagagggtgggaaatgaccaaaaggaaaaaaaaaagatcatagactcattgacccatgagacaaaataagctggtctaatgtgtgtaattagagtctcagaacaagagaagagagaagatgggagaaatcaataaataatattgaacaataaattaaaaatttgattaaaattgtatgtccaaagttagaggaatctcaattacccctaagcagaagaaacaaagataattaactcaaagtatacttaaccgtattgcttcatatgccagatactgaaggaaaatcttcaaagcagatagaaaaattaaaagatactttatatatagtaaaacaaggataagaatctcaaaggtttttcagaaaatatgcatgtcggaagaaaataaagcaatatctttaaaatgctatttaaaaaaaaaatcaacttagaattttatacccatgaaatatctttgaaaagtgaagatgccttaaagactaccacaggtatacaaaaggtgaactcatagccagcaacctagcattataagaaatgttaaaagcaaaaggaaaatgataacagatgaaccttggggtctacacaaagaatgaagaattctagaaataataaatacatgattatatttaaaagatgatttttcttatttttatatctctggaagaagataagtttaaagcaaaaaccataaaaatgtgatgtggagcttgcaacaaatgtagaagtatgatttaggacactaagaatacaaatgaagggagtaaacaatgaaagtatattgttatgacattttcatattatacatgaagtcattcaagatgaaacatactgtgttccaaaaagcaattctcaaaaaatttaaaaggatagaaatcctaagttttgtcttaactagaaatcagtaggaagatatatgtaaaattctcaaaaatttacaaaataaaccatacactcatatgaaattcaaaaatggaatcacagaagtaatcagaaaatacctgtgtaaaaataaaaacatgctataacacaaaatgtgggttttagctaaaatagtgcatagggcaaaatttatagcataaagctcttatatatgaaaggaaaataaggtctcaaattaattatctaagctcctacaataagaaattatataaagagagtcaaactaatcaaaattaagcaaaagtaaggaaataataaaggacagaaatcaatagcataggaaatgacaaaaaaataaagaaaaacaataaaacaagaagtttttttttttttttttaaagaagcactaaaattgacaaaattctattgggatgaatcaagaaaaagtagagaatacataacttaccaatgtcagtattgcaaaaagggttcatcactacaaacctaacagacatcaaaatgctaacgataaaggtgaattaggcgataatatgacctatgctatttttatcaatgtgataacttggatgaaatagttcacttcctacaaagacataggttataaatgctactaaagaagaaatagacaacgtgaatagtcttatgtctactaaaaaatggaaataacatataaaagtctcaataagtaaataaataaactttaagctcatacaggagcttctacttcttagagaagataaatatcagaattctttctaaattcctccatgaaagctctaccaactcacataaaaggagactctcttcattcattgattcatttaacctgagtacatcattctgctagttacatgagatgagaaggctaaactttattcctgctatcatgtttacaatgcattggggaataaagataaatcaacgattataattctgtatcttgaataataaaatagtgttttttgtttttatttataaagaaccattttcatctgctgattttttctttttcttgttccttctttttttttttgaaacagggtctcattctgtcacccaggctggagtgcagtggcacgaacatggctcgctacagcctcaacctcctgggctcaagaaatcctcctgcctcagcttcctgtctagctgggaccacaggtgaccacaagcatgtgacaccatgtttggctgattttttttattttttatttttcgaggagatggggtctgactttgttgtccaggctggtcttaaactcctgggctcaagtgatcctcccgtcttggcctcccaaaatgctggtattacaggtgtgagccactgagcctagcctcatctgctggttttcaatcattttaagcaattgcacattttctccccatagactatcactgcacaaatcacagaaggtttcacagaattggtagaaaacttcaagtgagtgcttttttgttgtttgttttttaaaacagggtctcactctgtcaccctggctagagtgcagtggcacaaacatggctcactgcagtctcgacctcctgggctcaagcaatcctcctgccccagcctcctgtgtagctgggaccacaggcatgtgccaccacaggcataaacatggctatccctaaaacagggagccccagtatccaagaagtacaaccacacacttgctactcaaaggctaggccttggttcagtagcattagcatcacttgggagcttgctggaaatgcagactctcctggccacaccatatacctactgaataccatatgcctactgaacaccatatacctacttaatcagaatctgcattaaagcagattcctagatgattcatgtgcgtgaccaagtctgagaaggccagttctggatcatgctggacactggagttggcatcttcagatgcatgagtttctccctctccatatttacatttccttcacccctagttccttactccagagatcaagttatccaatttgtgctccatgtatctctgacctcacactcctgacagcattcatttcccctgacatataaatgtattccagtctttccaaggtaaaacacaaaaatcactttctcaactgtgaattccccctaaacacagcctcttctctctcctctatgctctagagacagtgttagggaaagactttaaacttatagaaaaagttgcatgtatttggtctgaatttcctccttacattttattctataacgcagagttgtatctgttacctactattgatccacagaaagtctcccacacagatttccagtgacttcctaactacaaaactcagtgagcccttttagttcgcatctcactgacctccaatagaattaaaaagtgttgaccttgtctccttgtcttcctcttttataataaaagtagctaatatatatgtaatgtgtgttatcttcagatactgattaagtgctttatatgcattcaaaaaaaatttttttacttaaatttagtgcttttgcaattttcatgatactcccctaactccttatgtgcctatttgcctagcccttcttttcaggcttaggtctttaaatcattctgaataatctccagtcttggtcccataaattttcaaaactcatcaattctcctacaactgagtctagaataatttgatactcccccgagtaatataagaaaaatataaaaaaatttttatattttataaaaaatataaaaattgagtctcagtgcttaaaaaggaaaaaaagtttatgttccagatctataaaatttgatacaatgcagactgtacccatcatatggtggttggcaaagaatatctcataataattataaaaattcataagcattcttcaaaacatttccactttactactactacgtcccctaagtcgaaaagaagacttagatgaattctgcatctcttcattggtgcccaagtaacaccatctagaaatacaagtaacacttttatgtgttacaaaaatgtaaaataccaatgttaatcatttttaaaaataaaagcctattatttatcatactaaaaactttttgaaaattgtctatgtggctgagtgcggtggctcacgcctgtaattccaacactttgggaggctgaggcgggtggatcacgaggtcaggagttcaagaccagcctggccaagatggtgaaaccctgtctctactaaaaatacaaaaattagccaggtgtggtggcaggtgcctgtaatcccagctactcaggaggctgaggcaggagaatcgcttgaacctggggggcggaggttgcactgagccgagatcgtgccattgcactccagcctgggcgacagagcaagaccctgtctcaaaaaaaaaaaaaaaaagaaaagaaaagaaaagaaaattgtctatgtgtcagtcactccagcctccatccctttgtctggtccttactctcagctggtcaccctgattcctgttgcactgagaaaagtaaagcattcaaaagagaagttccatagacgccattttcacacccaccaatgcagctgcatctggtgcattaaaatctcatgcatccatggattctcatgtatccatgaattctcatgcatctcctgtcccaggacgtagaagcttgctcccatttcaaacctgcctccatacacacacaatggtagacattgccatttaaggtcatgtgcttcagcaattcccccctttctcctctaacatcaaataacccctctcttctgaataattttcatctgcttgtaaaatataattatttctctactctaaaaacaattaaatgtttgattaccttgttcacacctcttcccacaatctcatttgcgcccctgatcactttttttttttacagtaatgctcactgaaatgtttctatactccctctctgtttcctccaaccatttatctgaaattcatgccaattaggcattttcttctgccacccaataacactgctcttgtcaaagtccacagtgagctccctgtcgcagaatccgattaataaatttgaagtctccatgctcttgcagcacttgacgcaactgattacctcttccttgttgaaaagctttcatcgtttggctatcggaacaccacactcccctgtgttttctcccaatttattggcctctcttaaatctccttcttcatctccctattcctcttatgttgctgtgattcagtttaactcatagacctgttttctttctgtcacctcattgagcttcattactttaaacagtaccttcatgcatggcatttgttctttcagcctagaactctcacctaaattccaaactcctatgcctgtttccctacagcacatctcatacggatttccatttacatctgaaacatgccatgctcaacaccaaacttctggtctattctttctccccaccccacccccaaaactatctgtgcctgacacatatcccacatctcgtacattccagctttcttaccctagtttttaaggacaaaagccctggcaacaccactgactcaactctttctcccgttcctcatattgaatctctcaccatgaccactctagactgagccaccactatctctcatttgctcagtggattagattgtaccaagtaaaagaaaaagcctgagtgtctcacccactagacacactactgcaggtcccattctagtgtctctaaagaattgacaacttccttaaaaggaagtactcaggagccatattttaatgctcttaggaaaatatttccaagtggaaaatctttgtaataaaaattgagtctgtctttcagtttggacatatatctgtttaaaaagaatagcaacaaagttaatctttatttccctttcacaagtatattctaattggggaagctattgttctgatatgttaaagcaaaacattgctaaatggtacaaattctatgtgcttctccttttccagccaacacacatttggggaatattatatcactttcacgtttagctctcatcagcttctttcaagacctttaactattttacagacatatccagacaggtacaggttctgttccaatccctacaggtatgcatttaattatcactttaaattttaagacataaaaccagttatagagcagcgaagagataaaaagttttgagtgcaagaaatccccacaggagaggcatgttaacccttttactttctgaggtctcttttcagtagtgttggaatatttctttcagagccacgtgaaggggcaaggagccctgtcttccttctctccttgaggtgccattaattaactatgatttggccaggcgcagtggctcacgcctgtaatcccagcactttgggaggtcgagatgggtggatcacctgaagttagcagttcaagaccagcctggccaacatggtgaaaccccgtctctactaaaaatacaaaaattagctgggcatggtggcaggtgcctgtaatcccagctacttgggaggctgagtcaggagaatcgcttaaacctgggagacagacgttgcagtgagctgagaccgagccactgcactccagcctaggtgacagagtcagactctgtctcaaaaagaaaaaaaaaattaactatgattttaaaccactaaaacttccttctcatttaaggataagcctgtccaagcagggatgactgggccaagaaccttacattcgacacaggctcatcttttattccctgatgagggaagtaaaacctcctcctctgctctgtgtgctgtgacacagaataggtttagaagggaaaccctacaatacagcaggaaagaaatgtaactagaagctacaccacctggattttagatcttatactccactaaccaaccatgtgatcttggacaaataaatctcttctccttgtgtatgagtttccttgtccatcaagcttacctaatgaaattcacatctaacttcttctaaggactgttatgggaatcaaatctataagcctgaaagacatttcaaaatgcaaaatcgcaaagaaattacttgataattatatatgtagtaaagtgaaaacctccttttccttcccatttccaggctgagaaagactacttatctcaggatgcatattcatcccaaacaacttgtatttttacccttgattgatccctgaagccaataaggtttcagctttctatgacgttaacaggtactgcatacttccaatgttgacatccactgagttcttacttagtgttgagatttcatgaatcagaaacgtcaaagtcaaagatggcagctgttttaccagctgttttatccaatgctgacatccactgagttcttacttagggttgagatgccatgcatcagaaacgtcaaaatcaaagatgggagctgtttcattcagcaaggaggcaagtcataaacaatgatatatcaagtttcaccaaaactaagatcattaagaatgagaaataaataatgccatttaaaatttaagattccattgattgtgagaaaggaatgtttcaacctaggaaaatgtatattttgtatttggttaaaaaaagtttgtcatggtttttaagatttttgaaaataagagaacaggccgggtacggtggctcacgcctgtaatcccagcattttggaaggctgaggtgggcggatcacctgaggtcaggagttcgagaccagcctggacaagagggggaaaccccatctctactaaaaatacaaaaaataagctgggagtggtgatgcatgtctgtaatcccagctactcaagaggctgaggcaggagaatcgctcaaacccgggaggcagaggttgcagtgagccgagatcatgacactgcactccagcctgggcgacagagcaaacctctctcaaaaaaaaaaaaaaaaaaaaaaaaaaaaaaagaaagaaaagaaaagaacagtgataatggttagttaataaactgaacctacaaaacagaatctatttgcctatctatgtatctatgattacgtgccatgttccaaaaacttgatacatgaaaataaaatctcatataatccagaggactgctgaaatatctcaatttttttcctgttttgatacaaacatttaacttcttcatttaaaaaatgacatttattggccgggcaaggtggctcacgcctgtaatcccagcactttgggaggccaaggcgggcggatcacaaggtcaggagatggagaccatcctggccaacatggtgaaaccccgtctctactaaaaatacaaaaattagccgggcgtggtgatgcatgcttgtagtcccagctactcaggaggctgaggcaggagaattgctggaacctgggaggcagaggttgcagtaagctgagattgcgccactgcactccagcctggcaacagagcaagactccgtctcaaaaaagaaaaaaaagaaaaagaagaagacattattacctctgacattagcctaaaagtagcaaaagttaccgtgcaaattataacaaaatcggtaatcaaatgagaagtgagagagatcacgatatgagaatgaaatgaaccaattctaggtatgttgttattaacatgcctccaaaagtctcctccatgtaggaaaacttatttgtgattaaaattaccaagaacaatgttttatgtttagaaatgggtgctgataatacagattaagaagtaacagtactctaaatggtaagatgagttttgtaatataattatgactgttctttgttttattgttttttgttttgacacaggctcttactcttttgcccagtctggactgcaatggcatgatcatagctcattgcaaccttgaactcctggcctcaagcaatcctcctgcctcagcttcccaaagtgctgatattacaggcattagccactgtgcccagcctgttctttttcttggagcaggaattaaaaaactttttctataaagggccagatattagatattttcagctataagggccatataatgttacaagtactcaattctgttgttgtagcacaaaagcagccatggacaatatgtaaacaaaccagtgtggctgtgtttcaataaagttttatttataaaacaagaggcagaccagtttgccttgcgagtcatggtttgcaaacctatgccttagaagacaaataagctcagactgccctgcaggtaaacataccgggccgaacatgtctaacagtgtaattgtttccgttgaagaataatgtaatctagagtcccttctgggtctgaacttttacaaagggaaagcttagagtcatgacaatatggaattctgtgcattcttaacaaataatgtgagaatggggaggatgaacgggattgttttaggcctgtctccataagtgactaggcttaaaaatgctgaaacagccatcagtgttttcaaggttcagcctacttcaacacaatagtcagatacttactgcaaaataaaacagatgcaaaaaacacacagggacctaaaaacaatcaaagccactaaaatggaacatcaagtcttgagttatttaaccgttgggctgaagcaattcatcaaagctcctcacattaaatggcatctgttttccccacctttcaagtttcaattaacctttcatgccagaagggatcacattcaaacacctgagtcccattttaataaactggatttggttcagaacacctcacagttacctcagagaatggcaattacagaaacctgctcttgaatttgaaatttacaggaagaaaggtttcaaatgaccttcaattatatcttccttctcagcgatcagatgtaaaaatatcagcccagagtcactgatatttagggataataaatttataaaacaaacaccttgttcctcaagattctataaacaggtcaggagcagtggctcatgcctataataccagcaatttgggaggccaaggcaggcggatcacttgaggccaagagtttgagagctgcctggctaacacgcaaaactcctgtctctactaaaaatgtaaaaatcaactgagcatggtggtgcacgcctgtaattccacctatctgggaggctgaggcacgagaatcacttgaacccaggaggtggagggtgcagtgagccgagatcacgccactgcactccagcatgggaaaccgaaaaaaaaaaaagattctataaatatttatttttgtgcctatagatgtatagtttgtgtatggaatagggtagaaaattaaagttaagagcacaacagtcactccactagacagtgtgctctaattgtgttgacaaggattaccaatgcgggtaaaaattcagaataaatagttgattcagatacctcacagagctgtgacccacaagcctataacacataatacaaagtaaatatcattgtgttacttttgtacagcttgataagctctgtaccatgcacttacattcattatctattttaataaacaccgtgtaagatcaataggataaatccctcatttgaaaaatgaggttgaagacacaggttaattgatttaactgaattcatagagtaagttggttttgcagttaggattagaatcaagttaccatcattcacagctgagatctttcatccaggagaaaataagccccacaaaagctggaatttttgcgtgatttttttactgccacatctctaccaaactgcagggcacattataggtattcaaaaagttcatgttgaataaatgaatgaatagatatttttaaaatagttaaagtaggaacacagaaaaggtaaaagcagaacacaaacaaagacatgggatggcctcactctccttatccttgcagcaaatcaccagttttgtttatttctgctatgttttttctacatctcaaggggcccaaacccactatgacccctggtgattggccaagcggagttgaccaggaacaacactcagataatcagtgagggatcaaaagagggatcaaaatcaaggagttttagacccagtctttctacctggagggttgaccgttgacaagccattcgtctgaggagcctcaacttcccagtccttcctggcttccacacgtaactcttggggacttactatctgccttgcttaactacaggagtatgggaaaggtcaagtaagattatgaagatattttacacacaatacatattgatgaagccattattgtcctaattctgcattcattttctcagaataagatccagagtgaaacataggcaatgggattacactagcatttatttgctatagtggatgaagaccagaccaatgtctctggatccttggaagagttccctttcaccccccagttctgttcaaagataatccataacatcatttcattctgatgtcgggggcacctcttctggccaagaccctcaactgagctctcctgactgccaaaatggactcttttgactcattctctactattctccccaaaccttcagattctcctacttctcaagtccactgtccttggaatccttggaaccaggcagtctgcttggccttgtgtctggttacttctcagcagaatccaggctggtacagggcctgtgccccctgtattccatagggaagacagtccagtaaagcagatctccttttttgcactattggtgattttagacagtggtcctctaggacaatattacacattctcccaataaggatgatagagagatgaatgggtagatacaagggtggatggctggatggatgaatggatggatagatagacaaatagatatagatagataatagatagatggatagccggatggatggatagctggatggatggatggatgatggatggatggatggatggatggatggatggatggatggcttgctggctggctggctggatagatgaacagatagatactaatctaactaatagttagctgaagtaagatgcctcctgtacagttaaaagcgggcaagcattctgcccaggatatgaggaggaaccccgaggggaacaaagagatgaaaatatttgagaaacaccattagcaataatatgagtctcttctcccaaatggcatgaatacttcaaaagcatgtaaaaactactcagaatagctatgatgtaaggtgggagggtggtgacaatctatacctttagaaagcctgtagtcttccatctacacatcatatttttttttttggtctggttagccaataatgcaagcagtgggtagccaggttttaagaaggctctatattttttacatgaatttacgtatatccacacacacctgcagttaatgatctccccaagctgcagaagaataagaaggcccattcattcccatgaccccacgtaagcatagtcagatttgggtcaagtgttttaagtaccactgacgttctcctacctcacaaaagctttggcactggtgtttcctcaggtcccctgattccttgcagggctccaggcactggaagagaggaacaataaaaataaataaaacatggaaacaaacaaagctgagaggaaaaaagaattcacctgtgattgttgctttttcaatgcctgtttattctagttagtttagaaaaccaaagaatcagctgctctttttaactgggtataacacgaatctgagcaaaagcatcattacagaacgcggaccaaaaaatgtatttcaacacaattggaaaggaaaagttacagcgcccggcagtgacttacaggaaaagtaatgatcgtcaccatcagctggaggaattggggtaagacatattttctattcagtaagaaatattttcttttcttttcttttttttttttttttttttttgagacaaagtctcattcttgtccctaggctggagtgtgatggggcgatctcggctcactgcaacctccacctcccaggttcaagtgattcttctacctcagcctcccgagtagctgggattacaggcgcctgccaccacaccgggctaatttttgtatttttagtagagatggggtttcaccatgttggccaggctggtctcgaactcatgacctcaggtgatccacccgtctcagcctcccaaactgttgggattacaggcgtgagccactgcgcccagccaagaaatactttctaaaggttgttgtttcatgggatttttttcctcataaaagttaatattacatttcttttaaattggcagcatagggctattttttgtacactcttctacaagtgaaaatgcattgtattaaatttatgtctgtatgtatgtacacatatgtattattgttaacttgtgtccttatctcaatgaatccaacagcactcagatacatcgagtttaatcactccattaaaatacattgaataaatctgttagattatgacatgagagtctcataacagaaaataaggtttgcttaaacatacatgcatataacttattactatatacattctaataaatcaaagacactagccagactccattgttcaagaacgtttgtaataataaatagtaagattgttggataaacaaattatatgcacatataatatagtttattactaatatacactatatatattatatatacacacatgatatataaaatatatatactctgaggccaggtgtggtggctcaagcctgtaatgccagcactttgggaggctgaggtgtgcaaatcacttgaggccaagagtttgagaccagcctggccgacaaagtgaaaccccgtctctaccaaaaaatacaaaaattagcctggcattgtggcgcccacctgtagttccagctactcggaagactgaggcaggagaatcacttgaacccaggaggtagaggttgcagtgagccgagatcgggccactgcactccagcctgggtgacagagcaaaactctgtctcaaaaataaaaataaaaataaaaataaagcatatatagtgtgtacatacgggatgtctgtgtgtgcctgattgttagtagccaggcctcatggttgaaaaaaaaaatgttacattcatatgcatggaaacttgatcctcaaaattatatttaatgcaagttgtaattttaaacattaatagtcatatagtcagatgtcagtcatctaaatataagcatagccctagctctcatacattcatggttattttatctatattatttctatttcattattgatgagttttcaaatgacagtagaaattctcagttaaatttcagatatgtataatgtagaattccggatatatggtgaagcaatactacttttgcactctgttttctagtaatctcttccatgttttaaaatacagatacagttagaagatacactggaaaactctgaagaaacttaattttcaatatttgttgccatctttttatcaattatatgtatgaaatcaactgcccctgtgccaactgtcaattctttataacaataatgctcaaagtgtgatcaattactgatattatgggcatcctttggagtttgtgtgaaatgaaaattcatgggcctcattctcaacctacagtctgaatctctgggaccagggtccaggaatctattttaacaagttctactgaaaattctgatgcttagtaaactttaaaaagaactgccattggccgggcacggtggctcacacctgtagtcccagcactttgggaggccgaggcgggcagatcatgaggtcaggagatcgagaccatcctggctaacatggtgaaaacctgtctctactaaaaatacaaaaaattagctgggtgtggtggtgggcgcctgtagtcccagctacttgggaagccaaggcaggaaaattgcttgaactcaggaggcagaggttgcagtgagctgagatcatgccactgcactccagcctggatgacagagcaagactctgtctcaaaaaaaaaaaaaaaaaaaaaaaaaagaactgccaccaaatttgatgtttgcatttaacagtgtctttatggaataaatgcttgttggatgtttcttgagtgaaatgacaaagacttaccttgcaagtagctgaatctctgcccgtgaacaatccctagaccattactctttggagtaatgtctctttcttgcttcatataagtgccattaagaacatatatttctcataaaaaaatttttagatgtcatagtaatgttgcatatgaacattttaaattattttcatttttttaaaaaaacttgagctctttaataattcttttctaagacatatatgagcctgccccaagttacagtgcttacttctctcaagaatgttcaaaaacaaatttttcatcaatatagcaattctaaaagaaaaacaattttaatagtaatgaaacattgtttaaaaacttatctaaaggccgggcgcggtggctcacgcctgtaatcccagcactttggaaggccgaggcaggcggatcacaaggtcaggagatcgagaccattctggctaacacagtgaaaccctgtctctactaaaaatacaaaaaaaattatccaggcgtggtggcgggcgcctgtagtcctagcttctcgggaggctgaggcaggagaatggcgtgaacccgagaggcggagcttgcagtgagccgagatcacaccactgcactccagcctgggcgacagagtgatactccgtctcaaaaaaaaaaaaaaagaaaagaaaaaaacttatccaacttacttatgatttccttaaagaactagttttttgtttcctatggctacatcaatgctttgtcctcaaagctcttgttacttattttttctagacatttgcttcaaggcaaaaatgtttagtagttatttaaaagtatgctaagacctaattcttcctcaagaccatttgaaatgaatacatgacactcttgccactgcaaggtaagtctttatcatttcactcaagaaacacccaacaaacatttattccataaagacactgttaaatgctatgtggctaacaacgtctgaaaataagcatgtgatttttgttttctcttattgctaaaaatataaattataaaaatatgctgctacatgtgtacacagttgcattttcacaactatagatatcggtgcacaaaaagtctcaagcctttgaaatctccataatcccacataaccatggtcctgagagcttgtggaattgtcaaataccttatacaaaacaaatactatttacaaaaacaggcatatttctggaatgctaatcaaagcaatacacaacacacttgttttgctattaatccagaagctctgccaagtctagcatcagtatatgtcattcatttaaagctctattttaattgcattcctgcttcagatccagtaactagtaatcagcagtatctaaagacatttttcaaaatgttattaatgacagccaacattttcttttaataatcctccatgaaatctctctgacaagcacaacctatatacaatcatctgagtaaatgtttgcaggataagtttgccaaaagtctatttctttataatactctggccagttaaaaaaaaaaagatttcaacaaaagctaaagtgttgcgggagaaaacgacaatgacacactttctctcatacttcatgtagaacaaaaaacttcctatttctgcaagcaatttaaaaaaaaaaaaaggtatgtcaaaagactgcagccctgccagaggtgttagaacccaaaggactctatcttgaacaggggctgggtaaaatgaggccaagaactgctaggctgcattatcaggaggttaggcattcttagtcacaggatgagataagaggttggcaggactagttgcacaagatacaggtcacaaagaccccagtgatgaaacaggatgcagtaaagaagtcagtcaaaacccaccaaaaccaagatggcaaatgaaagcaacctctggttgtccatgtgctcattatgcactaattataaggcattagcatgctaaaagacactcccaccagtgccatgacagtttacaagtgccatggcaatgtccagaagctaccctatatggtctaaaagggggaggaaacctcagttccagaactccccacccttttcccagaaaactcataaataatctaccccttatttagcatataatctagaaataatgataagtttactcaatcaagcagcccatgccattgctctgcctatggcacagccacccttttattcctttactttcttaataaacttgctttcactttactctgtagccttgctcttgaattccttcctgcatgaagccaagaacccatgtggcctcccagactgaactccaattttggggtttaccttgtgacaaccccacatctctcttccacgagaggagtgattatgagagaaatactactaccaggagacaattgctttagaatgtattacataaactcctataggcgccatgatcatgtactgcctaaaactatccaaaacagtaaccaaagtttatatttttagcaaaggttttaggctttcaagttttaggatgatagactaaaatcatttcttccgaggctactgcttcaattccaatgaagaaacactttaaatttcaaagaaaaatatgtagattgagagagctaatcgcatatgtcatcgtttggcaggtagatactaagtatgtttctacttaacatagaaactttacagattacagaccacttttaaaactatttgtctagtggagcctcatcacaacacatctatagaagtatgtaaaattatgcactattggctgggaatggtggctcatgtctgtaaccccagcactttgggaggctgagatgagatgatctcttgagcccagaagttcaagaatagactgagcaacatagtgagactttgtctccactaaaaattaaaaaactagctgggcatagtagtgtgcacctgtagtcccagctattcaggaggttgaggtgggaggatcacttaagcccggaagtttgagactgcagaatgcaccactgcactctgcagcctgggtaacagagtaagactctgtctcaaaaaagaaaaaaaaattttaaaaagggcacaattattcttacattttagagaggaaacactgaagttaagagaggttaaggaaacaaagctagtgactctgggagagattggggcaattgggattgaacccatgctttagcacactcaaataaagggtattttccatgataaagcactttatgccacttgctacaggggattcatgagacaatgtatataaaagatatctgtacactgaaaagtactttgcaaatccatgggattagtaaactatggtgctcccagatctctctgggattcagttccagaatgccctaggtgttacgcattccaagaccttcatataagcacaaccaataagactatttcatgtcacagagagagacctccaactcatgagtggaagtactgatcaacaaggaaattgtggatactactttgtgaatcaccacctggccagtttggcaccaaattccatactttacatttaaccaaacactttcataaaaggacagcagaagaaatgttcttaccaaaacagccatcacaataaattctaaagcaaaaaaggttcacacgaaattcaaaattttacattatccaataatcaacaagtggaactcgtgatcagattatgctaaatgaatagaacccatgctaaaacaaagaagcagcaggtccatagatttcaatctgttcgaattagcaacaaattagctaaatcaacaatatggattaatatttctaatgtgcaaagtacttatctagtcaccaagacagggggaaatgtggcatgattcattctgccctgagggagcatggaatctcttatgggagaaaagtatgtagataaataagtccgcatcagtgaatcataaaataaacgagttaagaacgacatgccggccaggcgtggtggctcatgcctgtaatcccaacactttgggagggtgaggtgggcagatcacttgaggtcaagagctcgagaccagcctgaccaacatgatgaaaccctgtctctaccaaaaaatacaaaaattaggcaggtgtggtggcaagcgcctgtaatcccagctacttgggaggctgaggtgggagaattgcttgaacctgggagctggaagttgcgtgagctgaaattgtgccactgcactacagcctgggtgacagagtaagcctccatctcataaataaataaataaacaaacaaaaccaaaaaaaagtcataagaaatgaaaaaaaggatatgtattttcatagaggatcattgaaaagaacttcacagaactagggacccataaatcagcttagaagggtgactgtgactagaacttgaccagctgtaagtaaatttgggataaggataatattgaatgtatggagtggggagtatggtgtctgattgctagtaggagaaaacacatagcagaaaacaaggctggaaggatagcccttggattcaatgaggagccactgacacactcagaactaattgtttgttccaacttgtgtttatgaagacttgggtgttggaacagaagatggattagagaggtgagacattgcagtaaagtaaaccagagcaaaagtctttacaacgtcttccaatcttctgtctgccatttctagtgtcagtatgccaccagggtgtcagaggacattgggtgaaaggaggaaaaggatgttaacctatgaaagggaatatggaagtgcaatctcatcaacatggttaccaatttgttttgagaagtggggatgagagaaatcaaatggggaaaggcaccaaagtttccaatctagatctcaagggaactgatggtgtcaccaagacgaaggaagaaggagaaacaagcatggggaaagatacggaactgagtgcttaacacagcgagttagaggtgtccagggtacgtacaaggagtgttgtccaacaagctattgaaattgtggatatgcagtttaggataaaggttaaagctaatgatggcatttataagtttcttttgtctttctctctcatcattaatttattccttttacaaccatttcctgagttctaactataaccacagtatcatgctaagtgatgggcctatggctaaatctatgaactacacaagggactgccttcaaggaccttaagtctctacaaagatcatagcatgtacatttacaagcaaacgtcaaagatacagataaagaggtacagacaaaattaaattggagtgtcaaaaattttaggagttgggctatgcgaaaactagaatggcaacctgtatgagatttcatggtttagtaaagtttttttttctttaatctgttttgttctctctttacgtgtttgtgcttcaaaatgaggtgactggaacacgttaataggcagaaaacaaaggatcaaacggaggaagtctgactgaagatcaggatgattgaagatgtagaagaagtaggaaattatcaattgatcaaggtcccagagactgttgtaggggttacaatatgaaaacaatgaattttagagaggcaacgtatcactcctatcattgaacccaaccctatacagcttccagatttgaaaactgaaacattttcacagaggcaacggccaagtggtagggtttagatccatggctctgcctaggactggacatgaacgtacagtttcactccagcttagaggatgtaagcatttggatgtagggaaatgtgacaatgatcatgtggcatgttgataacctgtgtgaataagccacaggtttccaatatggtgggaaggcactgatgtttagatgtgtgtgccttcgtggatgcaattctggtggctgggctttagtagtcttgaatggatagataagtcaggccacttcccaggtgagggactctgaaactcatgattctagccaagtctgaaggcaaccaaaagagcactgagttttagatttggactgacccagaggagaatccctcatctacctcaagctaaatgattttttcccattcaagttttattttaacctctctcaactatacgtttctgatacataaaacagtgaaaaaatatttgctcaggtggacttttttcaaatgaaatttataaagaccaccttttaaggtgtctacacatagtaggtacttagtgaatctagttctcttccatttctaggggaccaataaggagactttattttatagttctttcatatttccctaatgcctacctacattttcccttttaattggaaaagaaattcaaatttctcttaattccagtctctcaagcatgttctaataattgtttttaaagtgccacatttcttgcccacatttccaaaagctaagattgaatggtgtggtaatattctgtgtgtggccagaacatggaatgagaagggatatcctgagaccatagcccagtaccttttctttcacaaaagtattttctgttgaataattaaaaaatcaaataatgccttatacttaattttgtctggagtattgcctggatataaagaataagccttggggttcttaaaaaaaaaaaacctccaactttttattttatatgggtatacattcatatcatataacaatgctatctacaaaagtttgcaaagaccatttctgttttctgaattaatggcagcaagtttctctaaaaagctgtggacctgctttttagatgaaagctgtttttttctcccaaatatatttcctaaaatatgtgcaccctactgcctttagaagtattcatggcctccctccagctctaaattggtactgtatagaaattgttacaatcctgtgtgtcgaaaagtgcactgtgtcttgccaaaataatgaaatcttttggcagacagccctctgaagtgcagttgaacaatcattgcagcctcaatcacagaggattagcatgccagcctagcacaaccacaacagcatcaggcctgagacgttcgcatcacaaatcaacttgctctgaaacgtccgaagggcaatgactctctcactgcgaaacttatcaggaaacacgggcctcattttatcacaactactttttcacaacaaagggagtccttggagtttcgggggaagtgtttagaaactacataagtaaatgagaggaaagcaatcagaaaaccatactctcagtgtaattcttttccacttaattaagtttcttgaagtagacaaagtcatggaattctcttacctggaagacaaagcataccttctttgcattcctatttttcaaccgcaatcttctaatatggcatttttggtacagtattgaagcttcaaatagtattcccatggtcactgctcaaatttaaaagatattaattatgaagagaaagtgctaactttccagtgtagaaacctagcagagcgcaccttaacaaaaggatcaaagatattgcctccaagaatgggggaaaaaagcaaaacgaaactcaggtgtctcctgaaaggatgcactagcaaggactcagcatctcacagaggcaggattcctgcccattatagagaacctgaatctaaccaagaggaaataccaaacaatctacaaagcaattagcctctagtcttcaaaaatatcaatgtcctgaaagacaaagaaagactgaggaatggttccagaccaaaggagactaaagatacatgacaacaaatgccacacataatgaagaattggatcctgaatcagacaaaataaggctataaagaacattatcgggacaatcagtgaagtttaaatataaaccgtagattagatgttggcgttacatcaatgttaaatcacctacacttgataattttatcaaatgatgttggtattatatcagtgttatcacttacatttgataattccattctcttagtagattctcttagtagttactaagagaatgcacttgttcttaagaaatgcatgcttaattacttggaggtaaagaatcatgatgcctgcatcttcttttcaaatgattggaaaaaaatgattataagtgtatgtgtgtgtatatatacacatagtatatatgtatacgttatacatttgtgtatatatacatatatgtatatgcagagagagagaatatgatgaagcaaatatagccaaaaaaaagaaaaagaaaaggaaaaaaaggaaaggtaacgactggtaagtctagattgggtcaagcaactagaaaccagggaccaaatgtggcccacctcttgtttttgtaaataaagttttattggaacagagccatgtctgttcatttacatattgcctgtggctgcttttgcactacagcagcagagttgagtagttgcaacagatgaccaagccagcaaagaatatttataaatctttgacagagagcttgcaataccctgatttagatgaaaagtatatggaagttctttgcagtgttctcataacttaagtgtgttttttaaagttaaaataaaaaataaattcataaaataatcttaaaattatttaaaatctcaaatcacaagttttctctagctggcattattaaaaagctattatggatataaatctatgggcagagagcattaaaaaatttaagttcctatcaatgggcttataggaataaacagatttaaagacaaatgcttcagatctgaaacctcataccaaatagatgatatgtcttcccaagcaactgttcaagaagaaagagacaaaacctagaatcttttaggctctgtaaagtcagtttcaataggctgtataaactggtggtttaaccacagcctcagaaaccctaaagtagaggacccagcatagcctcagtcatcttggaagtcccaggtaagctccagggtgactctgtaaggatcccaattgtccttcctctctgccatcacttctaattacaaaacacaggaaacgaggtcactcagcactgtggtccaatttgcctcttggaccctctgtgtccctccctcctttatactagataagtccttcttacaacatccaagcacgatgttcctcacaacgaagataggagatggatagaacctacttcttttgcagttgcaaactactgcatggcatgtcctagataagtattagttttcagtagtatgttcactccctggctacattcatacatgaattctaaaatcagcagaatcagtctgtgtttattaaaagtccaatgaaggaaaactgatgttggtgttttgccaagacagagcagtaaaggaggggtaggtgtcctttcctcacaggaggaagcttacatcctcacatgaacattttcctaaagacacaaaaaaactcaccctcagtgggaagtttactggcgcacagacagcttaataaaatgatatacataacaagacagccttttctctgggaaaataaaaatgcatatttaatcaaagtgctaaaaaatcagtaagggctagaaactattatctgtacatgtaatttccaacccagaaagtgtaacacacacacagacacacaattttttaaaattataatctgattataggacatctgtatatccttcggcagactatcaaatccatcgctcagctttctccaatactgacccccaggtaatcaaaataactcaagaatcctggcagagccattagccaggttttacaggctgaattaacgggatccatgttgtgcgtccagaatctcaagtgttcattagatcagattttgcgtaactcaactggaatcaccagtcacagcattcgaagaacttaaacagccaggcccgtctccccagtgaaggtcagaattgaatctgcacagcatgattctgacatcactgtgctgcaaggttaaaaaaaaaactgtgacaagttgaatggagattaggatttccctcacttggtgctatgtttaaaagcttatgctcatctagctctgatccttatctccatatatatttttttcctacacattttcttgacaacacacatctcctaagaaaacatttgattggtagtcctggagaaccatgtcaatcttattcccaagttgggtggcctggtgtcctttcttcctgtgctaatgaccttacaaaatgcggcatacatcacaggaggaatgggattttgctctttgtccctgtgttaaatctcacagagctacttataagcctgtcttatttataatatctgcttcttgcttaacaagattgtttatatcagtaatatataagaatgccatgggtaactatatgctgttggcttattgtttccaataaatgcatctctttgtctgagaggtgagtgattatagtaggttctaagagagaacctaaaatgaagcatgtctgtgcagtgagaccaatcagcaacagtgtcaacactaatcctcttctgatagaaggagcttgtaacactgacagcttaatatctatctgtgtggcttggttgtctgatatgtcaaactcaaggaaggcatggtgtgctcttgaaaagaccagggagccaaatctcatggggactttcatgtttcctgtctcccttgccagatcaaatcaccccagctttgtcaacatgaaagctcctctaagacattagtgcatccctgagcaaactcattcaatttggcattatgtggtaggtctgctccagattaatgagttagacatcatattcataacttttcagatgcttaaaaggaaacaccatggtggagaatgtatgttagttatggatggaaaactccgtttataatagaacctgtttggcctttaacccaaacttgaaatttgtacaacctcacttgaatatttaattttattctctcttcaccacaaaaagagtgatgttgaagttcttgtggccaatggaattccatcataatacagtaacaatgaaagctatttgtgaactcaaccaaaacgagcagcaagcactaactcagtaagtttggatcatgaaggtttgtttaactactgcagtctttcaagagattttgcacagggtttagaagagcctccttcatactgtgggcaatgcaaatgtcagtttcttgtgcttgttttcccttgttatccccttgactgaaatacacatttaaggactcaaccaaagatgtctcttcctcttgttgttttgcattttacaacttagctaactgaacactgttttgattaactctaagcttaccttcattacccctttacccattcattcatcagctgctctgctgaaccaaaaaaatgcagaaaaaagaaaaaaggagtagctcacattacctagaccagtggtgtccaacataatgcaagaatggaattgttctacatgtacaccatccaatatggcagccagcagccacatggggctactgagcacttgaaatgtggccaatgaggctgaaagatgaaatattcaattttaataaatttaaatctataaagctatatggctggtagctaccatattggagagaagaaactgaaaaagttaaaaggaaagtacaaaagtatgcattcaacatccatcacacccaccttccagtggaagaggaagtagaagctgcatttcccagatgatcatgccactgaaattctgaattcaattaggttatgctcatcaatatatttacgcagcatttgaaggcaaaaagaaaacagaagatattttcttgcttgtgccttgttcactatttctgtggtttagaacccttgtgaaaatgtgagggttttctgctgcagtcttcaagtcttcattctccagcttcctgggtatctgtagaggcttcatcaggggatggcccttgactctcacattgttactccagagagggctcagagcaagcaggagagtcagctctctgttttagagtcacttctggaggctgagcctagagtccattccttcaacacctctaatcattttagaagcatctaatcccttgtattaagttccttctagtttatgtacctagagtagtttgttttcttcactgacactacctgatgaaagcaactaagatgatacatgtgaactgaaattttttaacccttgtgacatcaaaaatgcaaagaatgtagccataacttttctgattatctattgtgtcaccaatatcatttctaatcttacaagagtctccctttactttgtaacctccctctctaccttctctgcgtatgtatttattgattcacatctatgcattgggcaatccaagagatattaggagcacgtggatgcatcaaacacacagtctgcatgctttgaccttagaatatgatggagaacaaaattaagccattacaatacagtgggatcaaagccgtgagacaaaggcgtacagaagtacagatggggagaacctaacccaagtgacaactatgcaaaattccctgggcaaagggatatgtctaggcagaaaacaaaataatgagtaggattaaccaggcaaaagcaggtgggatgagagaagagtatgttccagatagatttgatctttttaagcatgaaaataaaactgtaaattttagcaacatagaggcactccagaggtttctgctgtgttctgagatgaagacaaatgatctataattcacaggctatttagagtcaactttagctttgggacaagtgggagcttggatcttagcaatgcttagagcgactgctggatatgtttttagaagtatagcaggctttatgtagaccagtagaacaaagaaaagaaaatgattcttattgaagacatgtacgtttcctttatcagagagaaaggacctagctttcctttccccaaagcatgcataccactggtaaaacgagtaatctaattacttcaaaaagacagcactcgaaggtctgctttatcaaatgataagattccctaagtgaaattctaatgcacctgaaaataacttatataagaacatcatttttataacagacatgtgatatttacaatatagatgatgccattcatgcctgctttcttccacttggggggagcttaaaaagaatctcactcacacatgaaatcattttggagatttaaaataaagtgtacaaatcccacaaatttaaataggcagcttaatgtaatttaatgccactacatgtaacagtttaactggacaagaacacacagaaggaagagtaattattttccatgttttattagtttctttccaactcattcagattgttatacatatatcaattcataagagtaacttaaataccctgtatcctcagaaaactgtttcaccaagatgctgctgataatgtaccctcacttcaccaagaggaaacagatttgctttatttctaatgtcactgaatgtacgtttataatttacagaatgcttctcttctgcttctttactataatagaaatgtattcatgtttatagaaaaacaagaaactcatatccaacttactcattttaaagaggaaatgtgatagactaacatgcaaagaatatattacaaagagaatacaaggcaaaaatatcagaatggcatcttctgttggaaatagaggatactaaatatttttggaggttacacatctgtcagatataaggcaagtccttcccatgaagtgataagcttctctctctttctttgggaaatgtacttgctgttgctctttgttaatgagcaaaatcagtgacccctctagctcagaaaagactcctgatcactgcctccaccgcatccccacccagaggactaaatgaaccagtgacaacaaaatgctcttgtgccctaggccctctatttctcggagtttatagaccacctaacaatcaaagcagggcagtagggggaggccgtctttgtccctgctgttactttgtgttttttctcgctggcttcccagtcccctccgggcaccatcatcaccatatccctcatggctaagcagccagaggcatggggctttcactccaaatttcacggcatgatgaaatgcaggggctgcctctctggggatctcaaagccctcctttgtgggcctagttgagggtcaggttaagtagcacattttggcagcaggcatctgtttgtcttcacgccatgatcttcctaacaagggggagggagaggaagggaagcgggaagaggagagacagtttcagaaaaccaccttcacagtggcaagcaaattcccttcagcggcttgacagactatgaggccaatgtaaatccaatgcctaccacactgatggccccaccgaatcaattcgattgagccgtgagacagggagcttttcctttcttataggctgaggcctcacttgttgctctaaagagaaaaaacaaagcaagaccctttcttgctcagactttttataaagaaaatgaacctgtacaaaaaaaaaaaaaaaactgttggaaaggtcgcatttcttgttttttttttctcttgtaatataatcatagaattttaaaattaattcttctcaatacagaaaccctgttgctataattgggagacattgctactcaaggcaaataaagagctcattctatttaaagaaagcctttatgtagaaaagctttacaagacatgattaatattaattatttctacaagtcatagatacaatttctactctggaaagaaaccagtgggtagggattgttccctaaaaactcaaaccactgaatatgaccaaagtcaatagttcaaaagtagagttggttttctaatataattaaaacccacatatcaatgttttctcagaaaacagaattatacttcgttccctgtgtcattctctaagaatagatacttacttcctcatgtcagcctatatgcaagaagaataagccttttaaaatgatgagaaaattagtaggaaatgataaatgagaaataagtaggtcagtcagatgtatggagtatccggaagagtaaggaatatcacaggggattcgaaagcaataaaaaataacatacttcatgaatctgaagaatcattgtaaaaatcatcagatgcagacagacacacacatgcatgcacatacacacagcacaaagaaactaaagcataaattgccaactatctagctcacccttggtaaaggagggaataatcagatgtgcagaaagagggaaaaggaggtatcacatgatataaaacagcattcctcacattcatcttctcattaaaccattatttatttctgtgatcccttttttcttcagcaaagtggatgatattattccatcaatattttaaaaagaaaaacagtatccactggagaatcagcttctttagcaattgtcaccattgctccattacactatcacacacacaaaaattcaagacctgcacatcaggagatggaaatgcaaattacactggtgtgcatacacacacaaatacaaaggctatcttattggaagtcttcatggatttcttaaagcgcatgggaatattatgtcaaatattaaatacacaccatagtcagtttggcacatgaaagtaaagtcattccaaggtaatgatttaaaattgtgtggtgtttaggtagtctgctcatcttttctaaaaagtattcatcaaaattccccgaaaactgatttaagattaatgcttagagttctagataggcatccattctgccgggtttttttccccctgttgtctgggattttattttattaggtcaggggtttgcaataggggcaaaggaagagacacagagtttattttaatattgtaatgtaattctagagtaaattagtaaagttttatgtataaaatctcagaataaaataaatacaacatatttataattctatccataccattaagacttgtacacaaatgctccttacagcattattcataatagccaaaaagtggaagcaaatttcatatataattactgacgaatgaatgaataaataaaatgaaaaaagaatacatggaaatattgtttagcaatgaaaagaaatggaatactaaagcatgctacagcatcaatgggcctttataatattatgctaagtaaaataaaaagccagataaaaagattacatgctgtatgattccatcatttatatgaaatgtctagaatgagtcaatctatgtagggaaagaaaatagattagtggatatgtaggactgaaggaattggagggaaagggaagcgactgccaatggctatgggatttttttgggggtagtgataaaaatattctataattctgctgataattgcaagactataaatacatgaaaaaccaatgaactatttaaacaagtaaattgtacagcatgtgaattatatttcaagaatgttattaggcaaaaaaaaaaagtttctaaattcaccagtatatatatgtaatttatattgaacaataattaaaaatgtactgactttccctgtcaaatagattgtaagttaaaaattcagtgatcttcaactatcccattttgaatagattcatattgtcaaacatgtctattccattcaatggactaagcacatggatcggtatctcttaaagtgtgggtttggtcctcccctctcccacactccaccaagattaggattgagtaggtttgaagttgcagccagaaaaatgcatccatgggcaccccaggtgatcttgatgcaggctgaatttgagagtcatgagccatatagcagcaattacttcaaattacatgaagtctgagaatagatcatcaacacataaaaatggaaaactttataaagaactttcaatgcctcctctttcgtgttagtttttgaataataatttttcatgcaacataaccattcaaaagcaataattctagaaactgttagacagcaattacattaacttaaggtttatgagtcaattgaaacacatttttttctaggtgttgatgacctagaggaaaatgaccacttgaaaaattaaaaacttagagacatatcaatgaaagaattggcactcagtgaactcctaataatgcatatagaaggtctttattgaataaaatagaagtgtttgcaactcagaatcatctactctttttaaatgtcaatttaacaaaataatgtatcatttaaagatctggtgactaaaattttcagtataaatcatgtgttgcattaataagttgggccctttcattttgtgttatgctgttgttccattctacttgaggactaagctctgattctttcatgttgtccaaattcctatctaaggggtctagggagtcatgccctacaaaccataagttctcattagatgggctttatttaactctatatatcatgacttattttgcaacgtgactctggcataacattacgagacaaggaagaaaatcaaaatattttacccccaaaatatgttttttgttacattttgaaatggtcctgcaagccatcctttgtgaggaaaaatgcacatctgtaaagaatccctattaacatagctagaccttttccttccagtctaccaccttttaaagggtctgaataggaaacatttgtcatctattgtttctaacagcagccactgtgagacttcaaaagaactttggtctcctcaatcttttatcttaacctgaacatttcctttccattgatcccaggtctttagacaaaaactcagccaactgtccatcagaaaatgtttaaatttacctataacctagaagtgccacccccccaaccccgcctccactttgagttgttccgcctttctgaaccaaaccaatgtctttcttaaatgtatttgattgatatctcatgcctccctaaaatgtataaaaccaagctgtgccccgaccaccttggacacatattctaaggaccttctgagggctgcgtcatgggccatggtcactcatatttgactcagaataaatctcttcaaatattctacagagtttgactcttttcgtcgacatacttgtgtttaagatttagcttgacgaaaataccgttatgcagaggaccattcagcctgtaaagtaaaaataaagtaataaagttctaagcctccactcaatggaccccatcttagccaaggggtcccaaataaacctgaaaaattagttcaagccatgacaggaaagaagggacagacatgcctccttcctttggagtttaggcacaactgaccagcattcacattagcatagggatcttaagactgacaaaacagactctttgtagcaataagatacccaactccaacctgaccgtagtatagcatcacatgacagatagcaggccctgaaaaaaaaaaaagtattttacctcaaaatatatttctttgacatattctgagatagccttgcaaagccatctcttgtggggaaaatttgcattctgtagagaatcgccttcccttattagttcttttccagagaatctgacaccttttaaggtccaataagaggtatttaccatctattctctctgaagcctgctacctggaggcttcacctacatgacaagaaccttggcttcttcaaccccactgtccttatcttaactcaagcatttctttctgctgacttcaacatttcaggcagagcttaactctttcaaccaatcgccaatcaggaaatctttgaacccacctatgacctggaagccctctgctttgaaatgtcctgccctttcaggctgaaccaatgtatatcttccatgtattcatttacatctttgcttgtaacttctttttccctaaaatgtactgagaagctgcaacccagctaccttgggcacatgttctcaggaccttctgaggccctatcataggccacggtccttaactttggcagaataaacctctacattgattgagacctgtctccaatacttattggtttacaaaccttaacattatattagatgggtttcccatgtgtaatttcaaaatgcaatgctttcactgtaaaagaactcagctgcaaacacatgcccctcaataggcagctcaaagttcctccagggagaagcactgaggcagaggtgaagctaggagctgagtgcaacatcgacgaagggagtccaggcatcctgttgtccagcaggaggggaaatggccatgtctcagcagaaagaggaaccaaagagctttctgcaggtgtcggcagaatgtgaattgacaaagattctcaacttcacctttctgaagaaatacttctcgtgtggcccctcagaccccaggctcaaaacacacacacctttcagtcaacctgatttcagcaaatatcctaccctaacatagcagtagatttacctgtctggacttttgtttttactattacttcccctcttcatatttctccactcttcttctgaatgtgttctctttaagctttgttgttgttgctgttgtttccatttatttttatttttagtttcagtttagtttagttttgttttgagacagggtttcactcctgttgcccatgctggagttcagtggtgcaatcttggttcactgcagcctcaacttcccaggctcaagcgattctcccacctcagccttctcaggaactgggactataggaaaatatgaatagattcatattgtcaaactaaggcgcctgccaccgcgcccagctaatttttttgtgtttttagtagagacagggtttcaacgtggtctcgatctcctgacctcgtgatccgcccgcctcggcctcccaaagtgctgggattacaggcgtgagccaccactcctggctgtgtctgggtaatttttgtatttttgtagagatggggtttcacaatgttggccaggctggtcttgaactcctgacctcaggtgatccaccccctcccccctcagcctcccaaagtgctgggattacaggcgtgagccaccgtgctgggacaattttattcttttaggttaataataaagagcgaaaggaaagatggtgagtctagcaacaaggcaataaacataggacagtcaaggaagacatctttttttgagacatggttttactcctgtcacccaggctggagttcagtggcgcgacctcagctcactgcagccttgacccgccaggctcaagcgattctcccatctcagcttcctgagtagctgggactatcggtgcgtgccatcacctgtaataggcatgccatcacctgtagtagccgccacctgtagtaggcagataaagtaggattttgtgggcctagtgattttggaaaccatagctaggcctttaaagtcctttgagaattgctacattgaagtgatactgtatttctcagcatgaaaataaatgtgaacgctaacactcattttccatcttttcatggctgcaatagaaagcttcatgtattttgtagattacaattataagtaaaggctaatccccttccctgccaaaagggggaaggcttgagaataaaatcctgtttcaaaagaagatttctggaccggcgtggtggctcacatctgtaaccccagcactttgggaggctgcagcgggtggattgctttgaggtcaggagttcaagacgagcttggccaacatcatgaaaccctacctctactaaaaatacaaaaattagcttggcgtggtggtgcacgcctgtaatcccagctacttgggaggctaaggcaggaggattacttgaacccaggaggtggaggttatagtgagtcgacattgcaccactgcactccaccctgggctacagagtgcgaacctgtctcaaaaaaaaaaaaaaaaaaaagaagatttcacagggcacttgcatgctaccaatgagatcgaggtggagggtccgatccttgtctagggtacaatttgtcgtgagcatagaacgctttgttctaccatcaaaggcagaaatgtactattcatcttgtataggcagggtgtctcagcctccacgctactgacatgcagggcttatccataagcctttgttgtggggggcagttctgtgcattggaggatattagcaacttcgatgctagtagcacttccatcctcaggtgtgaaagcccgaaatgtctcaaaacattgccaaatgccccccagggacaagaactgcccccgggttgagaaccagtgatatagggtacatgcttataaataaataagcacgaaaccatcaccaccatagggaaaggcattcagaacaagtctttctggttatgactcagaaccctcatctccacaatattgatttcccaatcacacagtccagatggaaattctaagaaagggctaactcacgtaggctaggagagaagcaattcactgtcaccgcaattcaaaggatgatagaaaagagcaagcaaaatatatagcaagtcgcactaacacttgaaaataacttgagagctttcaaacaattcccacaaatccaaactgctttgaagcatatttctatgataattctggaatctttatgtaaaaaaaaagtgaactcttagcttttgagtgagttgagtgtattgccagcttagaaactattttagagacatttttcctcttagctacaagcagtaagcaagtgcacttcgtatgttcaatctccttaagaaaagacctgggacttcattagggtgagtgacagaggagaaaatgaatcgtttgagccaaaaaagcatcttaaacctataccttttaataatttctcatttcaacaccctgacatgctctatgcagcttgggcatctcattagggacaaataatatcatcagaacttcccatctccacaaagcatttgaaatccagtgagtttattaaatggcatagtgttataaattgataaatgttataaatttataaactgtataaatgttataaattgataaactgtacaaatattataaattgatagacaaaacaattaaaataatgcttccaggatgaactaatcttcgtagtggaaaacaatttatatgcctccaaagtgaaccaatatgatatattaaaatagaacaattggccaggcgtagttgctcatgcctgtaatcccagcactttgggaggccaaggcaggtggatcacctgaagtcaggagttccagacaagcctggccaacatggtgaaacccagtctgtactaaaagtacaaaaattagccgggcatggtggtgggtgcttgtaatcccagctacttgggaggctgaggcaggaaaattgcttaaacctgggaggccgaggttgcagtcagctgaaatcgtgccactgtactccagcctgggggacaaggcaaaattccgtcaaaaaaaaaaaaaaaaaagaacaattacatggaaattattgtgtaactgaggaaacaaatttaactggatgaagtaaatgccacaaaaatgcaataaacactcaaataactatttgccataaatctagtctaaaataatgacaatcatttaaaaattgctgtatctaagttgaggagttaaaaattgtttgtgttaatttttaattctttatatttggactattgttcataaaagtaatatcatagaaattacacttattatcaaatagcaatattattttaacaatgctttcatgaatctccaaaaggtccacatatgctattaaatagccagttttgacatatatactttctatctttctataattccgttgatgtctttgttcagtaaatgcaaagattagtcctgtgggatgttaaagaacactaccagcatcaggtgcactctaggtgtttagtaaagaaaaattgaatccaagagagaatagccacttagacaccttttctttgatataaaggaccaataaacggacagtctccccaggcagcatctcctttatcagcctccattaaaatggttccaatacagaaaggtgttaagaagtgaaaatccactagacatacgcttcactaccctcgtctacagctcccccaggaacgatacccaaattcctttagtgcccagagtattcacaaaagggccggtcctgacctccaagatgtttcataaattataaagtcaaatctattgtctacatctctgatggtgagaggcaggtatggatggaagcattgagggaaaacaaaatgtcagggtttattaaccccaagtaagagcgagaagagtcccatttttactgctgaggattttatgacccagggagttgacatacgtgactatgtctagggcaatatatcttgatagtgacaaagctagaacttgaagatatgtctcatcatggccagcccaccatcatccccagggattcaccaatgagccatcttatcaacatggtccacagaggtgggacctaccattaccattcccatctcctcctctgctttatttgttgccatacgccttattatcctcttatatcaatgaggacaagacttttgtctttgtccatatcagtatccccaagaacactttgcataagcaataggtattcagtgaacgaatacaacaataaaattgcatcaacctgagtcttaacatgtccaagttccccaatttaaaatttctcaacaatggtaacaatcatctcaaattttgcctgcataaaatggtgctccaacaagtcccatccacttctcagctacatcttctgggtgcaacagcctgctgagccccaatctgggggttgcagtggatttcccaggaagccaatcaagttcaaggtggcccctcacttgtaggagccccttccatggcactggaagagacccaggaaatgtgttcacatgcaaattataaaatttgcaaaattaacctattttctttttgttaaactacataagcttgcatctcacatgcctaaatcctgtagaagtgacaggctttatatttgacaatgacttgcccagtgttacttgtgtctactgcttatgatagtttcctgggggacccataagtagtgtaatcctcttgagacttgcaactttttctggaggttccagttctcctgggtccctcctggcatttccaggcaactgcagaacactgcagtgtccctgagctttgctaaaccattgctttggaatgtgctgataaacacatctgctggtgcatttcccattttctgtttctgaggagatcctgaagccttcttggataatcaggaggagaatctgaacatgtcaaatcacatgtatttgtaaatgagaacagcatggtcagaaatcagagctagaagatgggttaaatagaacaacagtaggcgtttcaagaggatagcaaaaaaagagagggttgaagatatcctactataaaatatcatctgaaaaagataaacaggctaggccaaggtgggcggatcacttgaagtcaggagttcaagactagcctgaccaacatggtgaaacgtcgtctctactagaaatacaaaaatgagctgggaatggtggcggacgtctgtaatcccagctactcaggaagctgaggcaggagaatcttttgagcccgggagacggtggtggcagtgagctgagatagcgccactgcactccagtccaggcaacagagtgagtgagactccatttcaaaaaaagatacaggggctgatgagaatgaattatcgcccacaggaggctgtccttttgaccacactgctgaatcaaagtcaaaggagaggtgtagacagggggaaacaaaatccaatttgtagtcacagagggagtactgggtgaaaaacattttgaaaaggagtcggggctcaacagaactagtttatcaatgaaagacatttcaaagccttgaaagaaaaattactaatgcccattgctaattaatcattctacagattctcatgcaaatgttctttggatggctttgatctgcactgacacctgaaagaaagcacacagtgtctccggacgggagcgatgcctgggaggcaatggcatgtgtgggtacacagccccctgtatgatcccctaataccctgggaactctggagccgctgagggcggccaagccacagaaagcagggctccagcctagcccatgctaggacctcagagatggctccactgtggccctttacctcccaaaccacaaaacacaccctgatcaaaagcagatggccttcccatgccctcgtccttaacaccaatgcaaatcgcctcccagaactgttcaatactcccatactcactgaaaggagaactgaatacgttaaggtcttgaagaattggggagaaaaatgttaaataaaattaactagatattggcaaagtaacaaaactgttacctcatcgatgggggaaaaaaaagactacttggggaaaattaaagagaaatcctttttcaaagctatgttctcaccaatgggtagccaagtgtcttcaatttcgtagtcttacctgatttataacaggagtttgtctgagagatagacctcatttaaaatttaaaattatgtgaaatcaagaaacgatttcccaagttgagatctctccactggcttccacaaggtcactcaataataaaacattttgaagtgggaaattgctcgtacaaaactaggcacattgccgccttcctacccacgtggaataaactcctgtctgcctagtagtttagctgacatttcatttactttcctaaagtttcagccacaattagtgatcaaagacatctggggtcctgtctccctagggtgtactcccagggaacattcattttagacagcaggtaaagaaaacaaggaagtcgttggcactggcctgatgtgcatttattttttatttacttggttttttgtttggttttgtttctgttttttgacagagcctcacggtgtcacccaggctacagtgtagtggtacaatcacagctcagtgacacctacatctcctgggctcaagcaatcctccacctcagcctcccgagtagctgggactacaagcatgcaccaccatgcctggctaattttttttcctcactaatttttgaaagatttttgtagaggtagggtcttgctatgttgcccaggttggtcactaacacctggcttcaggcgatcctcccacctctggctcccaaagcgctgagattacaggtgtgagccactgcacctggcctcccatgtacatttagtttctgatttttgtttttaggaatgattcaacatgatacacatattcataagaaatagcaaaataacctaaaatggaagttagcaagaagaaataagagggaatgaggacatcaagtggaatctgtaaagagtgtgataccaaactacactctactgagtcctcaacacccactgaatgtaggccacaaatttggatttcagcttcctaattcccaacaggaaaagaagaacttgatcaattcctacaatgcaagtattcacataagttaaaagcatgaaaggaacctggaagaacaattatccccaatacaaaatctaaaaataattttcttctgaagttaagaaatatcacgttctaacaatagaaggtactcaagcatcctcaccatggcaaggttgaggagtttcatagagctcttcttcatggcatgcctcacacaaggatagcatctcaccaaagcaaagtcagtatcatcaattctacagggtccaacaaattgcatgagcataaccagtcctctgtccacctggaccaaaccagtctttgtgcttacttatttaattaaatttatttatttatttatttttatttttgagacagagtcttgctctgtcacccaggttgtagagcagaggcacgatctctgctcactgcaacctctgtctcccgggttcaagcaatcctcctgcctcagcctcccgagtagctgagactacaggcatgcagcaccacactcggctaatttttgtatttttagtagagacagagtttcaccacgttggacaggctggtctcaaactcctggtctcaagtgatccacccgcctcaacctcccaaaatgctggtattataggcatgagccactgtgcccagccatcatgcttacttagaatactgagtataattcagtattattatactcacactcactcacactaagatctgtttcttttgttcttgcttttatcatctgctcacctcttcattgcagttgctttagatttggtcatctcggggtgaaagaagaaatagggctcaacctgtagctattggaacaggtctacatgaacccactgtcattttgcttggatgctctcctagattgaatgttcctggactgagagcctagtaaccagatagtggattcttgttatctactccagtaagtgaagtggtgcctccatccttggagtcatcctggacctctctcctcccaatttcaatccttcagcagatcctgtaggctccaccttgaaagtacttccccacatacctacaatctctgccttacttcctccagatttctgctcaagtgtacaaatacacatgacctttttaccttacttgtcggaaaataaacaccctcctcaaaccctagttccccttatctggctcaatttttctccctggttctccttactaaccacagtacttgaattggctcactgcgttttttgtctgtctcacgctagaagggagtttcatgtgggcatggtatgtgtctgtcttttcaccctatggtccagagtccataaaagctttcagcacacagtaggtattcaataaatatccagtgcatgagtgaagaaggagacagcatgacatggggttgcagaaaagaagccaatgactttgttttcatgttaaattgtattgagtagcaagcatgatgccacatttgagggattcagtagtgaccagaactgaaatggctatagccctccagccagctaaatcccttggcactgatcctaaaagacacaaaattcatggctgtgaatatcagcttgagcctcagatccttctctgtctttactctcaactccaagccatccagccccagggctagagctgacactgccttcgttaaacctgttcccctggttcttgaagccaaatttggtcttatgtctcccataggtctgtatcaggagggcagatgattctggcacaatacttcagtataaacaaaccacatgtgtaaccaaaaagcaaccaataaaattaagtacgaatgttccccagcaaagacaatctgtgctctgctccaaaggaatagaattccataaaagaaaaaaagaaagctgtggttttcttgaaggtctatctctattccattcacctgtacagatatttatctcagtaaccaaatatgtttttgacctactgctaaaaattcaccaccatgggaactaaaataaaacaaaagtctttttacaagcacagattttacaaacctcgattcttgctttcatctccgttttattcaccaagtgtagaagcagtacactttctaaagaatttaacataaagagcctttaacgtctccaagaagcaaagttcatgaagagcccaccctgtgattccctgtcccatgactacggctctcagtacggtgtgttgacatgatttctcatctgttcactgctctagaatagtctatcagctccttaaaatcaggggccgggtgtctcattcaaagtttggcaagctaagcccattgggaaatgaatccactctgacatttgcttttgtacagccccatggtgatatttaattttcaaatggttgaaaaaaaataatattttgtaacacctgataattatatgaaaatcaaacatcagtgtccaaacacgaagtttcaatgggatgtagccatgcccattcattgccagattatctatggctgctttcacgctatgtcagctacattagcagtccccaacctttttagcaccaggatctggttttgtggaatatattttttttttccatggactgggtgaggaggaggagaatggtttctggatgattcaagagcattacatttactgtgcactttatttctattattattacattgtaatatataatgaaataattataaaactcaccatgatgtagaatcagtgtgagccctgagcttgttttcctgaaactagacggtcccatctgggggtgatgggagacagtgacagatcatcaggcattagattctcataaggagcctgcaacctagatccctcacatgtgcagttcacaacagggtttgtttgcactcctatgagaacctaatgttgccactgatctgacaggaggcggagctcaggtggtgatgtgagccatggtgagtagctgtaaatacagaataagctttgcttgctcacccagcactcacctcctgctgtgtagcctggttcctaacaggccatggaccattaggggtccgaggccctaggattggggacacttgagacacatcaccacaatcatgctacatcgtcacactgagtggttgcaacagagacaactctgtcccaggaagcccaagacacttgtcatctggccctttagagaaataattttccagcccctggtctaatttatctcctcctccccacagtgcagcaaggacctagaacatagctgatgttcatcagtgtttattaaaatgaactgaaattgtcagcaaaactctgacctctggaaataatctgagatcccccaaattattattttgttatcttataaagcacttctaatacaattagcaaaggctctagcaattacaaagcaaactcatctctcatagaaagttccccagctaggaaaaactggagaaggtaattttatctgatggtatgtcattcagtccaagtccctcaaaacatcagtggagtaagcagaactgtggaattgtttctttgattccaggaatcctagaatcaatacccaacaccattatcacacacacgagcattaggccttgccaagggtagcagccagtaaatatcaggaatggagctaaggaatcagaaaattgaaagaggccccaatttttatgcctacaatatctgacccagccactacctgcacatctccacttcataagacatctttctgcattcccgcaaatgtgtcaaattgggagaaaatccttcctcatatcaaagcagggctaaacctgttgcctctctacctttgatccagcagtgatagttaaaagcacaggctgatgcattagaatgccttgttgtgaaatgtcctaggagcctggcaaattgtgtagcctttctctgcctcagttttcttgtcaataccatggggacaaaaacatacctgtgagtcttgcccaacaatatttaaggcacctacctttcatgatacgagtcagccataccctgtccatccagctgcttggaacctttactgccctcatcctttggggcagactttccattttcctttatgccctgagccactcattcatcctcgtctaagttgctaagcttttctactgaagttattgcaatcattgcaaatatcttcttacccatctccctgcctcctgagtctctacaaattggttcttcccatggaagccagtacctttctgcatggcatggatccctgttctgcaaagtccaggctctttggaacacagttctcaacgccatacatgacttgaaaagctcaactcccgatgtgaggctcttggcgttcaccctcagatgaccatatgttcccccaatgagccagtacctcaggttccccagacacatgctgagggagtctgtgcagtaagaaatctgatctcactcaaagagagatctgttgtccctacccctgggaggcaatctctaaacttgggatgtcctgagtggtaggtgtctttgttattcatggtgcccctaggaccatgcctgttagtttttgctagttaggaggcacctggtagagcccctccaggccaattggtatgagcccaatctccagagaagtgggaagggggcaggcagagattgattttaaccacacgggtcatggctcgatcaatcatgcctacggcatgaagcctcagtaaaaactctggacacttgagctcaggtgacttcccacgtgggtgatatttcgtgcatcctaccatgtgtggaaatgcatcctgaaaacaatggaagcttcgcattgggaattcccctagactctaccctgtgaactcctcttttggctggttcagattcagatcatatccctgtaatagacgtgagccttagcataatagcctgcagtgaatcctgggggtatttttagcaaattgtgaaacctgagggtggttttgagaaatgctgaacttgtggttgggcagacatcttgaacatacttggcaatttggaggactgtgcttgcttttttttttttttttttttttacggagtcttgctctgtcgcccaggctggagtgcagtggcacgataccagctcactgcaacctctgcctcccgggttcaagcgactctcctgcctcagcctcctgagtagctgggattacaggcacgtgccaccacgccaaacagatttttgtatttttagtagagatggggttttaccatgttggtcaggctggtcttgatctcctgaccttgtgatccgcctgcctcagcctcccaaagtgctgggattacaggcatgagccaccgcacccagccaggactatgctcttaacctcagaggttggcacagtctggttttacatgatcctaagatggagaataaggaagaaggggagtgaggcaggggacagaagggagtccagggtacactaaggtaatgctttatgctctgagtacctgggggtcacctgcactgggaaccactgggagtctgttctccttctcaagtgacagggaagccatggtatttctcatctactacctcctgtctattggcacttgagggcagttcccgagggcattaactcccagtacctctagcctgcttctcagtcagaatagggaagtttccacactatgagcaagttctcagatagagagtggcagatgcagcagaaagagctgtgggtgctcaatgtattggcaagcaccatggaagggacatggttaatgccctactgcatgagctcagctatttctaatgcctcagatatgccctggtgcctcttgctttcttgtaacatgctgtccaacctccctgttggacacggccaaacccctccacctcccacgcttccaattagctagctcttcctcagaggtcagctttaatttgtcccagggttatgggtccttctcctattttccctgccagttcacttatagcattttcaagctgttaaaatttcctctttattgcttgttttccctcctaagactatgtactgcttaaaggttggactcatctgttttttaacctccatgccaaagatacttacgaattgttcaatgaatatctatctgttggatggatgaattcattctgggactgaatgtatgaatgaatttaatacttgctctcaggagcagtctcaccttagagggggtcacaaaaattcgaatggaataattgtagccatggaacaacctccttgatgaagatatgctggaaaatatcttcacaagccctcagattacaccacctagattagaggactacctcttctgctctcactttgcaggtaaagaggcatgcaccagaatgctgtggaaacatgatcaagagtggatggcaggctgggcacagtggctcacacctgtaatcccagcactttgggaggctgaagtgggaggattgcttgaggccaggagtttgtgaccagcttgggcaacatagaaagactttgtctctacagaaataaaaaattagcagggaggccaggcacggtggctcacgtctgtaatcccagccctttgggaggccgaggcgggcggatcacgtcaggagtttgagaccagtctggccaacatagtgaaacactgtctctactaaaaatacacaaaaaattatccgggtgtggtggtgtgtgcctgtaatcccagctactcaggaggatgaggcaggagaatcgcgtgaacccgggaggcggaggttgcagtgagccaagatcgtgccattgcactccagcctgggcaagagaatgagactctgtctcaataaaaaaaaaaaaaatacacatctatgtatatattagtagggtgtggtgatgtgtgcctgtagtctcagctactctggaggctaagtcaggaggattgaatgtgaccaggaagtagaagctacagtgagctataattgtgccactgcactccagcctgagcgacagagtgagactctttctctctctctctctttctttttctttctttcttccttcctttcctccctccctccctccttccttgcttgctctcttccttccttccttctctccctccctgcttgcttgcttttctttctttctttctctttccttccttccttccttccttccttcctccctgcttgcttgcttgccttccttccttccttccttccttccttccttccttccttccttccttctttcttttctcttttttcagggtctcactctgtcacccaggctggagtacagtggtgcaatcttggctcactgcaacctccacctcccaggctcaagtgattttcctgcctcagcctcccgagtagctgggactacaagtgtgcgtcaccacacccagctgatttttgtacttttagtagagatgggattttgccatgttggccaggctggtttcaaactcctggcctcaagtgatccacccacctcagtctcccaaagtgctgggattataggcatgagccactgcgcccagcttgtttttagagaaaaacaaaaacaaaaagcaaaaaagagagtagatggcaggttggaggagggacactttcacactttggccaagttctcaggcagatgtaggcagaaatgcactagaacatcatggaaaacatgaacaagagcagacatcagcttgacacccactgaacacaggggagccagcatagaggagaaggggctaccttcctgcatataacatgaaacccatccctgataatgacttccgaggcagctctctgggcaacgctgtcttgttccatacacacaaaaacttgtttcttgttccacacacacaaaaaggtctcaggtggacatgtggacattgtctttgggagactggcttaggtttgtttgtgttctccccattcctctgccttctcctgactaggcatcagactcaagtttggcccttgcacatacttctccctgatgagttattaatactaacctttgcttgcaccatgaactttaatgacatgcccaaggtcagccagcttgccagactggctctaaaacccacctcattttatgaccaagagatatggccagggacgggggctcatatctgtcatcccagccctctaggaggccaaggtgggaggattgcttgagcccaggagttcgagaccagcctgggcaacatagtgagaccctgtctataattttaaaaagaaaatttttaaaaaagagaaatgcatatagactttaacccaaaactatgatataatcttgttgagaatacaaactctgcttcatgcttcctatgcatacatgccctaaagaatgtatagagtatcctgtaagtagcatgtctttgatatatatttatcataataaataaaactttaatggcccagagagtgctacaagccggggcaggcctagaagctgaacagcaaacaggaggacaagagaaccacagcagtgcaaagtagaagacatttttaagtaacacactacacattacagcagtacacagagcagccaggtgagaaattatgaggatctaggtggatgggtcagttttctagaaatgccacaataaagtcccatagactgggcagcctaaacaacagactatttattttcccacacccctggaggctggaagttgaaaatcaaggtgtgggcagggctggttcctccagaagcctctctccttggcttgtagatgctgtcttctccctgtgtcctcatgtggtcgaccctctgtgtgtgtctatgtcctcatctcctcttcttatgagatgtcttattcatttcaggctgctatcacagaataccatagaccgggcagtttataaacaacagacatttactctcccacagtcctgaaggctgaaagtccaagatcaaggtgtgggcagggttggtgcctcctgaggcccctctcctgggcttgtagatgttgtcttctccctgtgtcctcaccaggtcatccctctgtacatgtctgtgtcctcatcttcttacaaggacaaccggtcctataggatcagggccctccctaatgacctcattttaccttaattacccctttaaagaccctaactccaaatacagtcacattctgagcaactgggggttaggacttcaacatctgaatttgcagggaagacagaatacagcccgtaacagtagactttttggaatgctactgcctgtttgattttaatgcaggattatatttgactacaagtccaaacactatagctagcctagaagggttgcagccataacaaaggtaataaagaaccaccttccccatgacccccatgtggtccttgccccctgatggtcctgggcaagcacagttgatcacaatcccaattagcactgttacttctaggagcttaaaaacaacagcatcgcgtttcaactagcccttctgccagagtgcatgtgctacaataacatactgtaagggacggacatcaaacaggagcacatcctctcggggaaactgcaagaaagagggtttaaaacactccaatgaaatggagcaagctgcaatgaccattaaggacacgctgagcacagaaaactcaacaaagatgaaagaagaaagaggaactaaaccaacactagtccttggtaaattacatgaacctcgtttcttggtatcttttgattacactcaggcctgaggcatctgtagtcctgcatcaggctgatgcccctgaagcccaagatctcactcccagctctgctcttaatgcaggacccacaatttttgctttcttctgtaaatgaccagatagtggatattttaggcagggatggcttcaagggtgagcaaattacagtcacgcagggccccacatttagaaggggcccaaccttggtttaatgctttgccatcactgtcttcagattcttaatttttcaaaggggccttgcattctcatttttcaccgggttctgcgtataacaccacaggtcctggttttcatcttcgcgggccatgcagtttccactgaaattatttgactctgccggtgtagtgcaaaatcagctacagaccataagaaaatgaataagtgtggctgtgctccaataacatttcatgtgggatgctgtcatagattggactgtgttccccccaaaattgatatgttgggcccccagtaccctggaatgtgaccttatttagaaatagagtctttgcaaatgtaattgcttaagatgaggtgtttagggtgggccctcacccaatgactggtctccttataacaaggaaaaatttgtacatagacagagatacacatagagggaaaaagatgtggagaaggccaggtgccgtggctcacgcctgtaatcccagcactttgggaggccgaggcaggcggatcatctgaggtcaggagttcgagatcagtctggccaacatggtgaaaccccgtctctactaaaaaaatacaaaaattagccaggcatggtggcaggcacctgtaatttcagctcctcaggagggtgaggcaggagaatcgcttgaacccgggaggcggaggttgcgatgagccaagatcgtgctagcctgggcaaaaagagtgaaactctgtctcaaaataaataaataaataaaataaaataaaataaaataaagatgtggagacataggaagaacatctacaagccaaggagagaagcctggaactcatccctccctcatagccctctcagaaggaaccaaccccactgacaccttggttcacacttccagtctccaaaattgtgagacaataaatttctgttgtttaagcaaagctgtttgtgatactttatcacagcagcctgagcaaactgataagagatacggaaatttaaattgcatataattttcatgtgtcaaaaaacattctgtttctttggatttttttttcatcatttaaaaatgcaaaacccattcttagctcatgagccatacaaaaataggtagcagggcagatttgggctgcaggcagtagtttgctgactcctattgaaactgtgccccgaggagttaaagaaaccaatgactaacagaaattcttgagtttgcaggatggtagataagaaaagaaacaacctgctgaaatgctgaaactccctatgcttgtaagataacaaaactggctgaaatcagttggaaccaatagatccaactggagcctgcccagaacaaagcttgctgacatcatggcctgaatttctatcttgtgtttcctactaactccctctgaatgtgatccatgaagtactgtgaagaggtaactatgcctgcccaaggactttccataccttccctttccttccaccaatcaaccactaatcccaggatccaccttttctaataaaattattacattacatggaatcaatccaatgcccatcaatgataaactggataaagaaaatgtagtacatatgcaccatagaatactatgtagccataaaaagagatcatgtcctttgcagggacgtgggtggagctgggagcctcagcaaactaacacaggagcagaaaaccaaaccctgcatgttctcacttataagtgagagctgaacaatgagaacacatggacacagggaggggaacacacactggggcctgtcaaaggggtgggggaagggagaacatcaggataaatagctaatgcataggtgatgggttgataggtgcgacaaaccatcatggcacatgtttacctacgtaacaaatctgcacgtcctgcacatgtatcccagaacataaaataaactttgtttgtttgttttctgagatggagtctcactctgtcgcccaggccggagtgcagtggcgcgatcttggctcactgcaagctctgcctcccgggttcacgccattctcctgcctcagcctcccgagtagctgggactacaggagtgcgccaccacgcccggctaatttttttgtatttttttagtagagacggggtttcaccatgttagccaggatggtctcaatctcctgacctcgtgatccgcccaccttggcctcccaaagtgctgggattacaggtgtgagccaccgcccccggccagggatttttttttttaatatggtactttgtagcctctggaacagcaatacagaaattccagccactacaaaataaatgtatgcgtgcatgcacacacacacatacacacacacccctttaccctttcagttgagccttttccataaacaaattcaccctcccttgatgaacttgatttgcaaggctaaaaccaaataaggtgtaagttaagaggagagcctgctgacacaagggtaccccacggtctctgcagataggtttctcctcctggtaaaatctcaacaggcacagagggcaagaaagaagagcagccacggtggtgtctctgcctccatcacaggctcttctgcattctttctctagcaccatttctctttttgaagaactcagtgattatggcttttggggcacaatttcacaggtccgcataagcagatgtttttatgcatatcgtctcccccagggctctcttgtgaacactgtataagcaggcacacaaaatgatgaacaaagcgtccccaggacccctctgagatagagttgatctcaggcatgagcaagagaacgacaagacaagcctgaagcatcccgtcatgctgcaaaggcgggacgtgctcccagaatgacaggcactcatccaacggacgcagcagtgtgcttcaaaattccccacaagtcaaaccttgacaaactggatatcaaaacaaataatggtgggaatggattccaacccatttcaatacttcagaacccatgagtccatagtgacaacacacaaataagaagataaagctctgccttaaaacagaaagtaaattactaactgcataaagaaagaagtgcctggcagtgcccaggctgatctgtcacagagttgtacttcagaggtgagatattgcactccctaactcaatcactagtcaaaaggtcttgttaatacaaaagacttttctaatcttggaaaaaaatagtggaaggtaatactgtccaatgctaatagctaggtggtagatatatgggtaacattttttccctccaactatttccattctttacgtattttgaatgggtgtgtactgcttttctcatgctcataaagacaattgttgaactctaaaacatcaaaatatttcattattaagactactcagtatggatgtaaatattgcaggtgctgagatgttggggacccaattcacttaaacattttttaaattctccttttatataagttactagtattggaaaataaaacaatcagttaagttgaccttcaataacttaagagataatggtggcaatatccaccatgattattttagcaaagcaaattactttggatgatattctttaacatttaaaacgttggcatttctttactccaagtcctccatgccccattttttaaaaagaaagggaagagaaagaccagacttggtggccaacacctatgatgcttgagctttgggaggctgaggcaggaggattgcttgaccccaggggttcaagaccagcctgggagacatagcaagatcttgtctcttcaaagaaaaaaaaaattaattagctggacatggtggtatgcacctgtagtcccaaggctgaggcaggaggatcgcttgaggccaggagttcaaggctgcagtgagctacaatcacgccactggactctagcccaggtgacagagcaacaacctgtctctaaaaacaaatatgatactaataaaagaaaagaaaaaaatcccaaattttaaccttattatataatctttgatgtatatttaccagtatgaagagtcccctttgttgtatttaacaaattctaaagaataacacggttatagggaaaataaaggaaatagaaagaggttaagaatgtttacattttcactattatcaattcaacaactccccaaccagtattagattattttccctatatcataaatgtcataataaaaaatgaaataaggttcctggagcctgagagaaaataaatacatatacacacacaatggagtcataaaatctgcaacattgtaagttttcccgttgtaactttcaatgtgttgaagcatcttcttagttggttacaatgaacactgaaaaagctaaattgatatatccccaaagtcatgaaatggtatctcagacacagggatgaccttcagaggaaaaatgctccacattccccacatgcccaagaagcaaaaatggacagactgtttttgtactaaatgaaactgtggcgtccatccaaaatgtggacattgacatcggcgctgataagtccccttcaactttgcatttcctcctcgtctccaggcttcttcataactggaaattttgactctcacacaactcacttcaccttgtatgccccaggatgaggttgaggggggcccagacaacatcaccccatgaggggaaactgccccaaacaaatacaccaagtatcagcagtaggaatagccagggagaaaatataccctgctctaggctaatttgactatgaaaaagtttcatttttaggccagccattacccatggcttgggctgaatagtatagaactccataggtgttagaaattataaactctgtcctcctgatgctttcacccaaggctgtcccatcaggtgctcagagctgctgaaatttctccttaaaattctagcaccacaacattcaagtctaaaaagtggaggaattgagtttacattggtttgactggatattcaagccttcccgtactggacaaatgaaactcttctctaatttccataaagcttttgtttgtttgtttgtttgttttttgcggggggatgggggtggggagttggttgttttcttgagacagagccttgctatgttggccagcatggactcaaactcctgggcttaagcaaccctcctgcttcagcctccagagtacccggaattaaaggtgtgcaccactgtgcgagcttcattcaagttttagaacttcatccttaattttagacaaaaacagaggaaaccatctcatcaaatcactccacattttaaatagaaaagcagagttccagagaatgaaaaccactgtgggccggggcttgcacagtgggcaagagacgaagtgttgactgtaatgtgggtcacacaccctttgttcatttcagaccctgtgaggtctactggagataaaatatcatcagccgtatgggggttgcttcttagaaggagtaaggtaaggtagagtaaggtaagggatttagtggcccaataccagaaaggagtagtgtgtttttagaagacattctcccaaatcctgcctggccgagaagggtaagagtatggctgtggaggattaggagagtgggggagctgagagcatgaattgtagagccagatggactggattagaatcttgtcactcttgccttccccatatgcataatgagaaaagaggaataactattttgtagaagtgcaatgaggtctgagtgactgcaaaatgctgacgagtgtcaagtgtcaggcgtatttaaggtatttttaaattttttttttatttccataggttattggggaacaggtggtatttggttacatgagtaagttctttagtggtgatttgtgagattttggtgcacccatcacccgagcagtatacactgaacccaatttgtagccttttatccctcacccccttctcaccctttccccgaatccacaaagtccattatgtcattattatgcttttgcatcctcatagcttagctcccacttaggagtgagaatatatgatgtttagttttccattcctgagttacttcacttagaataatagtttctaatctcatccaggttgctgcaaatgccattaattcattcctttttatggctgaatagtattccatcatatatatatatatatatatatatatatatatatatacacacacatacatatatatatatggtattccatcatatacatatatgatagtccatatatatatatggtattccatcatatatatatgatagtccatatatatatatatatatgatggaataccatatatatatatgatggaatactatattatatataccatatatatatcacaatttctttatccactcattgactgatgatcatttgggttgattccacatttttacaattgtgaattgaggcacacataaggtctactaagttaaaacaatagcaatgaaaacctccacgtctatagtaccagaattgggattatcaacaaaggtgcagggtgccagcttccagaataccactgacccaagagaggcaaatcaacctgtgggagccattaaccttccactgttctagccacaaacacatcgtttgactgatcgactttgagtcaaaaggtttgggatgagaaaggggagtcacagtatcaaaacgatcaagtctccagagcctggtaggagttctgagtcactctcctttttaacttcctccttgcttatctgcagctgctctctgccgcctgacggccttttgcccaggaggtcagagaaggcaaagctgtctctcagtaattggagatgtctggctctgtgtgtgggaagttgaagggacacttggtggtgccttcctccctcaaagcgtcacagcaagtcctttcattgtggctaagcggaaatagccaaaagagaaagggaaaatatcgtctcttatgaagacaacaagaagaccaggggtgtggaatgggagaaggatgaccaggcacagcacagggtatttctaggactaggaaatcatggtataagataatgtaaaggtggatgcatgactttatgcatttgtcaaacaccacagcatatacaacagcaagagtaaaccccaatgtaaactatggattatagttaatagtaatgtatcgatagtaatccatcagttgtaacaaatgtatcacactaatgcaagataacagtaggggaaataccagggaggaggaagggagggcatgggaactcttcattttccactccaaatcatcatatggctgatgatattcagcatccaatagacctcacagggtctgaaatggaatgccttatcaggcccaaaactgctaaaaaaaaaaatagcctattattttctaaatctcagattgcttaatattcttatatacatgattaataatgtgtactattatgtatgtacatcataatataggtaatctcatgcataatatttaactaacgatgatacctgtaagaatttatcacttaattacaaaggctgtgttgagattaacagtccttcaaagaaggtggatgggttgagatgatgtggtagatcagaaagaaagcacaatttagaatcctatatagaagttttctgaaaaacagacacacagaaccgattgctttaattatcttaccatcatttggatagggtaaacacaccagtttgcatatactcttaagtaactttcatccaagtacagctgacatgaaggtagcttgcccaatagataaacgatgagagaaaagtagagaaaacatttactatcttttttattcataaattctaaccctcccccacaaaatgtgttggaactatgtgattaattctattaaaagtatgctcgttctgtctgtaaatctgtggagtaaaaaaaaaaaaaattcaggagtggttccccatcatcagaatctgggctcatcatttccttctttccctgagtttataaagtatctatcagcatagtgcctaagatgtaccagaacatttacagaaatcatgatttccttttgtttttgaagcctcatggacctgcaaggtaaagttttatttttctaatcattattttggagaagaaaagggcagggagataatggtgatggatgcagccgagagttgggattggaattggcgttggctcattcctcagcctctgattccaattggctgtaccacctaacatccatcatgtcgccttctcaccgaggccaacatttcagaaaatgccagtcctcatctctccaaccacgcttgtttaattaccattgagggaagcaactacaaatactcctagggccaaaccctggaagaatcccagcaacacacagaaatattgaacttacccaagaattttcctagatggccataaataccatgaaattctggacaactcaaatttacatctctagtcctgactgtttctgggccagagacttcagatgtccacctgcctgtttagtagctccccttgatataatctcacaggcttaaacttattatgcccaaaatgaattttaacagggcttccctttttcacacaaggaaaagcccggctgctcctcttccagtcgccttcacctaagtaactggcctttctccccactttcctaagaaactggcatcagaacggatgtttccatctccctcgcttcttgtatccaaccctggccaattttgcctcccatctcccgaaatccatccgcctcaccctgccttcactgcagcctcacctgagtgagctacccacctcttctgtctaaattagtgtgtttgttttggaaccagactcccgctttccattctcagccttcttcatcattccccaaaatatcttgtgtcaaatcattcccctccttacagcctctctggcttccatcactgcactttatacagaatataaaagacttgatcctctaaggccctgtcgccaggtgtcctgtcatgatacagcagcttcttaaacttctctataggtaccaaataattttccacctcagtgccattgtacgtgctcttctctttaactagaaaacccgactcttcagaagttcatatcctcagagaacttttgcaataattcatatctcctatctttcttagcatagtaccctattttctcaaaatcatgtaataccatgtgtattaactgagcaaacactgacttccttactttcttaagaccttctgtgtttagtgtactaattctgctccatgaaggcacggtctatatctgtatgagtagtaccttgcaatcttttgtcaaataaaacaacatctatacataatttacatgataatgctgcatattatgtgtatgagtatatatatatatatatggtcttgtatacattatatatatactatatatatagtatatgctgtatagtatatatatgtaccatatacatagtatacaatagtatagtatatatataagaccagtatacaagtatacaagaccataagtgaaaaaattccaacgacaggaattaatttgctttcttttttaactttcaaaaaaattattatttaattggcaaataaaaactatatataattattgtgcagaacatgctttaaaatatgtacacattgtggaatagttaaggtagttaacgtatgcattacttcacatattaatttttttgtggtgagaacactcaagatctactctttcagtgattttccggaatacaatacattattaactatagccaccatgttgtacaatagatttcttgaccttactcctcctaactgaaattttgtatcatttgaccaacatgtccccaaactacctccttcccaattttcttaaatttcattaaaaaatctcttcctggaagaaatcacagtagtagactgatgactggctttacatatacacacatgcacatacacacacacacacacacacacacagacacaaacacaccccagtcatgtttacaccacaccactcctctgaggtcagattgagttaacactggagcccactctgcatgcaatgggagcttgcaaacccacctttatggcagggagcatcaggccttcagtggcccctgcatgtgaactgcctccatggtctgatgctgaggacaccctgctggtaatgcagagaactgtgcatagaaatccctaatctgcctgtccagttccccctgaattggcttgaagcagtgggaagtcgaaccacacaagagagtttccttgtcaagtgaccggaggtcagtgttattatctctgtcagtggccaggggtgcactggttcccagcatatgagtctttcattgctaacaagctccactgcatttgagagagcccctgggataggagagcagggaggcttatctcctgtctcctggatgaggtactgagaaagagacaccctccgcactctgctcctcactgaccaatgaagggactcacgaatctgttaatttatcaactagggtgttcgacctgaacactagtgatatcctgattgtaacaggaaatctcatcaattagaggatgtctgatctaacagggcaggagaccataactgttacttgtattgtttcagggagcaaaaaacaagagtgaaagaaagcattaacaattaagaaagcattttcttaatttctccagagaaaataaaacccaggaaaataacaaaagcaataaggaaattaaaactttatccaaggagcatataactaaataaatgccatctaatattgggcatcatcaatgtactttcaactttatgtccgcacatcatagtataaaagagaactgtaaaaaaagacaactaagttttacattgaaatcatttgttatatcagatgtttttaaatataaacatatgaaggtgatataacaggatattaagatgaaacctgtattttaacattgttaatgtgtcaccataaatttaccttttggcattattttggtaaacagcactgaatgttccatgcacggcaaacaactaatttaatgtagcttttaaattggcaggccatactaaaatttagctattttctttgcttactgatgtcatctagaatgacgcttttgttgttcttttccacagacttacaagcaattttatgcaacatgacgctgcttccaaagcatccagaactatggaacttggcaggtttaccagtgtctgctcgccccaactacaacctttatggaaaaggaaggactcagtcagacagaactggagagtttttccaaatgccctcaaaaaaatgtaccctggcttgaacaagagagccagaacagcctggtgggacgtcagccttctagatttagcatgacatgggcagcagtgcagttctgaagaactcccctgcagcacacacagctcctgatttctatctgtgctcactggtctggattttgagagttttgagaaatgaattgtgcatcctgttatgcctcgaaacgttaactcaactcatatttttaagtggtcacgttaggtaagtatcccctcattagaacagagacaatgcttgattcattttccaggttgagttgtagttaacatgtgagtgggatcgaaccaccataggtacagatgcttagagaacaggaacaacagagaagggacagagacagtgaaggaggctgtattgtcttcacacctttacaggcagggcgacttcagcaagaagtaatttaccacccacactaagctctttatcccagatttgctttactgtctctctctacccaaggtgtcaaacactcactctgtcatcatgttgcaaatggcactagtaaaggaaacttccccagctcccaagaagggccttataaaccaagtgtaacaaccttttggcttctttctttacaatgagaaactcattagctggattattttttttctttttgacatagaaataatctgggactcctttcacttttatgtgatagaaagataagacgcagaatcaacatacaaatctgctataaagagtgcagaaagcacttcctcaaagtctcaactaacttttccccaaaaaactatgcttgataaattcatgttttttagaaatgggtaaaaaaatgcctacttagtctgttttgctgtttatgttagcgattctgtgatccagtgacgtcagacttataaaatcaacaagtttcacaaacagaataagaatcactccttaaaataacaaatgttacccgttgagtgatgtgattgctttatcgtctctttaaggcagggatgtccaatcttttggctttcccgggccacactggaagaagaagaattgtctttggccacacataaaatagactaacactaatcatagctgatgagcttaaaaaaaattgcaaaaaaactcacaatgttttaagaaagtttacaaatttgtgttgggccgcattcaaagccgtcctgggcctcatgcggcccaagggccatgggttggacacgcttgctttaagatcttagggaaacagaaggttaaaatgataagcatggaactgaagacttcataagaaaatgcacatgtcccattcatgtgaaattcgtaattcacacatgtaacttcctgactcacccctaaaatgtgggggaccccaggaaccacagagaagctccaaatggattttctcaagcaaactgtaatatataaatatatattttacctcctaaccaggtcttctctgccctgccttctgccctgtcttctttccacacaatcaacctcatgtaatgtaacagcaaatcctcatttccacagcccacttttggtggaagagtcatttttcccaaatatgatcgaaaatgcattatgtgagccagtgaaggaaatccagaaatagggtctagttcgtctgggctcctgtacatcctatacaagaaatgaactttgcaaaatcccaaagctgtgaatttggcacctctcaactagcacaaatttcctttcaaacattaggaagagaaagagaaaaagagactccaaagtattttgtaacataatgtattccacatttccataggcatcatttttaggccaaaacatatggtaatacataaactgatcatatgctgcctgccacgctcagcagagaaaggcagcatctcaaaggatttcctcaaatcctttactctaagaaaggcatggaaaccatttcatcagaaatcattccctccgtggcagtgtgcaaagacagtccacccagatgcataataaagcctcaggaaataatgacaacagcagcctctattgcaagtggagctgaaaaaagcggtgggtcttaaccactgatacaatgcaatcattaagatatttaaatataagaagaccatttcatgcgtctctaaagcttaatgctactatctcaacaatccagtgtagaaattgttaagaggggtctctctctgggtgccttaatttatatttcttttttttttttagtttttatttttattctaagttccagggtacatgtgcaggatgtgcaggtttgttacataggtaaatgtgtaccatggtgatttgctgaacgtatcgacccatcacctaggtattaagcccagcatgcattagctatttgtttggatgctctccctccccccaccccaccccccgacaggccccagtgtgtgttattcccttccctgtgtccatgtgttctcatcgttcagctcccacttatgactgagaatatgaggtgtttggttttctgttcctgcattagtttactgaggataatggcttccagctccattcatgtccctgcaaaggacatgattttttcatttttatggctgcatagtattctatgatatacatgtacattttctttatccggtgtatcatatattttttacttctgtaagcaaaatgtcattttgactgtttctcttttatctaacccaaatggccaactagccacctttatttgtagggccagcaaaaaactaaattttagtattgggttcctatatgtctcatttaatattatatactttgattttctctccaaattacctcatttggccaagataacataactaatgtgcaactacttaagcacatccctgagttttctttttaaagtggaagctaaaggaaaactaagacacatgcattatgttatctttatttgtataagctaatcagagtaaaatggtcttcccaaatatgaaaaataaaatgacttgatacatgtcaaaaaagggcacatcatctgtcaataagtcctgttgaagtgtgaggggaagggagtgaagttctgcttttctttaatgagatgtccccataaaaatatgatttgtgaatttgtaaggatccctaactgtcacataaagacctggactccacccatgtaacacggtcatggtctagccagttttcttttttaaatatattcattttttattgcaagggttcatcctacacattgttataacagacaaataaatcacttcacttttctcacctgtaataaacagagagcttctctgttttacagtgttacaaaattaaatgagacaatttatgacaaaccatttgtcgatcatggagtactccacaaacagctgagtactgttgctaataatatgacttcagtgacaatcataacctcagaaacttaagacagagcctgtctatggcaaagaaatctagaatctgtggtgtctcattcaaagaaatgtattttcatgagaatatcacttccctgctcccagtcctccttaacttttccctctcgcctgagaccacactgcctgatagaaccaaatgtcagcagtgacagtggggaatactctaagttggtgctgtccaatattgcagtttctagctacctaggacactcagcacgtgaaatgtgactagtgcagtttctcactctcgccactgttgacatattgggccgatggttccttgcgatggtggctgttctgtgcatggtaacactaccacgcagcgtgttgagctgcatccctgaccgcccccactagataccagtagcacctcttccctggtagtgacaactaaaaatgtctctcgacattgccagatatccccttgaggacaaaatcacctctggttgaaaaccactaggctacagagatggagaattttcattgtattcaatttaagtaaatgtaaacttaaatagtaaatgtggctgatgtctaccatactgaacggaattgctttaaaatttactgagattcaaaagataaatgttggacggatggatacccccttcttcatgatgtatttatttcacattgcatgactgtatcagaacatctcatgtaccccataaatatatacacctactatgtacccacacaaagttaaggaaattaaaatttaaaaagaaaatttactgagattatttttcgaaaacagatacaacagttaagaaatatgttggaaagtttagattacatacatatatatatatttttttcctctgaaagggctaagcatatgttaaacaatgtaagctttcattttatttacacataattatttatgtgctgcctttaactcagagcagtaagagagctcataacctagcaaggcataaaaaggtacaaaagtaataataaaatggaggagggggaaactaccacagtggttttatatccattcctgccacccagggagggaataatgagatgaacagatatcgatgggttgtagggtccagaactaaattaaaaaattaacagccataaccaccccaagctgttcctgctgggctcgccatgcttgccccacccaggcaaggtctggattgttcacaagcagcaggaatgacctgacccgcaagctctccacagacctgcgctgatggtttctcacttccctcattagacactgagccaaggcaaagaaacttttaaaaaagtgtttgcaagggttcatcctacacattgaacagtttagtaactatcactttcatttgaggagtgaaaacaatttcctatcataatgggacaactgtgttaggttagggaatcctatacgttacttaaagtcccaaagtgaatccaagttcaaagggaatattgtgtaaaacaaacaatatccctgagaatttcaaaggagattgaaccccaagtgcctagagattccaatgtcttcatttctggttctacatgtagggagatgatctgaaagaagcaatattcagtatgatgaaaaaattaaattttatatttcctttccaaatacttggagagagaatctactcagtttctgatgccaagaacagaaatttaaagtatgaagaaagaacatgggctttaaaaacaaaaagtcctgcaatgtagtccccaaatgacaaattttgggaaccttgtccattattccttctgaccctcagttgtctacattgtacaatgaggaaaatgacagctacttccttgggttattgggagaacttgaaagggcccctagaccaacctgtgtatgtcgcccatttcacattctctaaacttcaattccctttactgagcatggccaatcttagtgctcaaaggcacagaaaagaataaaagcttgctctgccttttaaggagttcacgtgagccccaacagttgtaatccacagcctcttttcccaaggagatgccaaacgatctggggagacagacacataaacaagttacccaaacactggagcagatgaaagaagtccatcatggaaacacacaccacttactgtgagagcacccaaactccacggctcatataatctacagagaaaatgttcccctaagtgaacaaccacccaaagagagcaaagtaaacaactttaattacaaaacagaaactgtcaggcatctgttaggttcaaggggcctttccaatggataaacagttataaaatcatgggttcatatatgtagttatccaactcaagagaccaagagactgaggatgataccatcctgccaaccttcagttcaacaactcagagtgaaaataataataataaaattaaaaatcggctttaagaggtaaagcatgctaagagaaataaggcagacacaacaggataaatatcctatgattccatttgtatgaggttctcagagtactcgaattcatagagaaggaaattagaatgatggttgtggaatggggggaatcaattaataattacattgattttctttacaagagtccctataagtaggcatattgagatccttaggcctctagagacacagagtcaaatgtttcacacttttaaattatttatgcttataatatccacctttagggatttcttgcaaaaaaaaaaaaaagtcttatcctgcaaaaaggttatttctacagtcaaattcataaaaaccgaaagtagactggtggttgccgggggctgagggagggggaaatgagaagttgttatttcatgagtatggagttttagtttggtaagatgaaaaagttccggagatctgttgcacaacaatgtgaatatacttaacactacttaactatacactcaaaaatagctctcacgctgggcgcggtggctcaccagttgcatttccaacaacgtctcaggtgatctgaggctgcagggtccataaaccacactttgagtagcaagagtctaaccaactaaattgtgaatactgaagctcagtaatcccagcactttgggaggcccaggtgagtggatcacttgaggtcaggagtttgagaccagcctggccaatgtggtgaaaccccatctctactaaaaatacaaaaattagcctggcatggtggtgtgtgcctgtaatcccaactactcgggaggctgaggcaggagaaagaattgcttgaacccaggaggcagaggttgcagtgagccaagatcgcaccactgcactccagcctgggtgacagaatgagactccatcaaaaaaaaaaaaaaaaaaaaaaaggctttcatggtaaatttttaatttttaaattatttatttatttattcttagagacagggtctcactctgtcacccaggctgggctgcaatgatgtgatcatagctctcagtggtaaattttatgttttgtgtgtgtgtgtatggtgtgatttttttaccacaataaaaaataaaaatgttacttttataataaaagaaaagctgtttattagaaagaagtaatagtcataaaacactaactttcttcaacatatttcaatgatatttcttcaaattaaatttccaaacagacaactgtaataaaaattttgaaccagggtgtttttgttggtgaggaaaagttttagagttgtcgatcagatgatatcccaggaagacataaggcaatctaatcaactgtgcttatttctcctattttatacaacttaagtgacatggaggcacctgctcatttcaccttccacactgagaacactgctctcagctcatgtccagtaatctccttcttcccgtcattctctcactctagcactgagcactaatcaactctcataatatgtgatcaggttatgtatggtacagattccctagttaagagtatcagaatatgccatcccaaaatatgctactttggcataaggattattttgagctgagagcaattgagaagcagtagatgcaggaagaactctctgccttccccatttctgcttaaaagcagacataaatttcccctttgtaaaggcaatgtaagtttccatttgtaaaaaggttcccttcttccataccaggaagagaaaaataactcatattatccgcataacaagccttagtaaacaagccttatctaccatacatttctaggtcactttcccacaatttactgcccggagcccaaaacccccttttctttgtctattctcctctccacaatgtattgcccttcattaaaatggtatataaacttctaggtctaaccacttctttgagtttttatttcttttctgtgaagtccctgtgcatgtgaaattattatcatcaaataagctttgtttgccttgttttcctgttaatgtcttttgtgcattaaatttataggccccaataacagaaccctgcaagggtaaaaggaaagcttttccattgctatactagtgtatttacctagatattttatatatgacaaagaaaactagtatcaatacaaaccagtaaaatgtgaagatgaatatttacgtgctttcaagagaatatagttacatctcgtttgagagattgcccagcctctcaaaacctgacttccctcttttttctcttcctcatggccacactaccaaaagaaaggagaaccatacccggaatgaaatttctccctttccacactttcctcaagtaacatgcagtctgccccctgtcttccaggctttcctaagactcctctttcaaagtctccaaggacatcaaggcccattctatggtccccacatcttattagccacaggactttgagagggtcactctgtccagcattttgcataataatcaaggaaagtgaatactttccattcccatctcagaaagatgctttaaaagcaaatggtattcatttatgtgacaattctttgcaaactgtaaatcctaaccaaatgtaagatattaagataatgaccaaagatcaagccaaagttactatcaacatatttggggagaaatccagaagtaataaaaatgtcaaattactcctaatgtaagataaggaagtgaaagaatcacactgattgggggtacacttctgagagcacagaatttaagatttctgattcagatgactgaatttatatccaatccactccccacacagcactccatcacccaaacgaacccttcgcaagcacggggtcaggcacatggatggcatatatttaaaacttaacaaatgaaaagtgagctaagaaggaggaatgggggtaatgagtttccaagactcaataatttcaggctctacctgcaaaaaatatgtaagcaaaaaactacaagtcatggctaacaggcaggaaggattaatcaattggtcctgggactaaaggaagataaatgtcagagaaagctacagagaagaaaaaaaaaaaaagtaagatctggcttttttcggaaaacgagaatttcaccacacacacacacacacacacacatacacaaaagggactggagcaacaggtaatgtaataagtgtaaagagaacaacaaagagatttaacacatgctatatggctgttcaagacccgtgggatgcattaagccgtttaatcatcacaagaatctatacagtggcccctactattatctgccccatttttcttcagatgacaaaatcgaggtacacaaaacaaaatcacttgctcaagatcacatagcccctaagtagagaggccataatgtgctgattaattcctgaactgaattttagtagtcacaggcttgccacttgctcttcatccccacgctgtattacctctccaaagtactacaagcaaaagcaaagaggtatgaaagaatgtggcatgctgaggagtctgggaaaattgtctaatgagaaagaaaaaaatgaaccctgagaaaatacacacacacaaaaaaaagcagagtcatctggaaagttagatggagactcaatataaaggatgctgaaaaatgtgccaaaaatttgatgtgatcctgtaggttagggctaccacggaccatcatctactggaatcctcttagaaatgcagactctcaggccccagcccagacacaccacatcagaatctatggaggtggggcccgggaatctgcatttgagcaagcccgccacgggattcttgagcatgctaaagtttgagaagcacaaactttaagaccttgggatctgtgaagagcaaaaatggagagaaaaattggggctatgggattaccacattttagggatagtaaatgcttcagtgatatcagaggggatagcaaaacagtttgagagatttatcagaaggactttgcaggcagctagatagaaaagtaaaggacgaggagcgatgaaggaggattttgagttttttagcttgggtgcttaagatatattaatcttttaattaatattaataattccagagagatatacaggtttggggagcactagtaagtaactcggcccaggtgatggagctagtgaatcccttcagcctttaacactggtgcccaaagaccaaactctattgtgcctctcactcaaacggcagaagatgtccatttaaatcaggacacatcaatgtcaaggatttagataggatcttaaatcagaaatagccagtaaaaagttgaatctagaaggacaggaatactgcaacggtctacatgtgttacagaaacaaggcaagtaaagaagaggtatttccttggccaaaaatagaattcttgctctgcctcccaaatatcagagagcaacgccattgcccccatttcctttagattatggtgattgtgaaagagaggcttcaattctattctttaaatcatcttagggcttgatttatgctgctgctgcgaatgcatgactgacattatcctgcaagtccaaacagaatgcaggcaaactagtgttgcctttgtccggatcaggaggtaacctctcagcagagtgacagctaatgttataacactggaggtttcagcacggtgcacgcaaaggctgggagatgtcacccttctgatctatgctactttttcctgacaaatactatgctaggactgcgcagaaaatgattcagaagaaatatagaaaatcctccccatgtacttattctatctgagctcatgtctgcttataacatggccattaccaaccagaaaacaaaagttctaaggaaggttattgcctttctgcctcaaaacaaactagggagacaggcagaggatgcacaggatgcatgtggggaatagggcaacattcagaaacgtgaaaacacagcagacaattgcacttgtggcaaatttgccttgggtcttggaactgctatctttgaagggccttcacaacagggcttcccggtcatcaggggactttttggtgctgcttcatccaagagggctaagatttacagttgattagcctgcatagttcagttgctttttcaaaagattctaggaagggattatttctgtgcccaaagagcccctagagaatagagaaggctgcttgccggccgtaatgtgaattccccagagtcggtacactgtgctcactgaagcagatgaagtaaagttaaagaagcatttagttcttcagaatgccagccttaataagtatctttttgtggaaggatttaggaggaggggagggttatccttagtgcaggcattatttcctcatacaaaaagggaaaatgtgcatacagttggatgtaaaaagccaacctcgaatgcctgccccccaccccccgccttccccgaggaaaagttgctgaacacacactcccaaacacgaaagcatgaatcttcacagcttaatagtcccgaagccattgtgaagtttctcttgggaaacactgttcattcatctgcgactgaccaagttcaaccattcagctgtgagaactcggagacttgcagccatcaaaagacccaccttcctcagcaagcggaagccagaggagctgcgtccccaaggaagatctcgggaactcgcttctcctctccacaaggatccgttccagccccacaagagaagtctgcagaaggctgaatctgggtgcatctgcaggcagctcaactcttaaatgatctctgcttgcacagttcaggggttgtcctggcccctgcggctctcacagttctccctgcaaacagtgctccttatgtggaatttgacacagaattagtcacttgcaatgagttaaaatgagtatgatttaattagacagtttcgcataagcccaattttctaaccaacagcaacattttcctatttaaaccctgcgttttcttcaacctgtcatcacacaggaatatacacattgacaccaactgagctattgctattaatataatgaacacagtatcgacagagtggccattccattatcgttaaataagccagaagccattcattatacctctctgtgcttaaaattttcagctggggctcctataacttaaggcagagagaaagtctttcatggaaaccaacataaacatttgccacccataagaatagagagaaaaagggacagagagggagggagggaacaattgaacagaaaaaagaaaagaagagaagagaagagaaagagaaagaaagagaaagagagagaaagagaggagaaggggaagaaagaaagaaggaaggaaggaaggaaggaaagaaagagaaagaaaggaagaaagaaagaaagaaagaaagaaagaaagaaagaaagaaagaaagaaagaaagaaagaaaaagaaaggaaggaaggagggaggaagggaaggaaggaaggaaaaagaaaggcaggagggaagaagagaaagaaagagtgcacgagcaagatttacaaagtgcacactttaagtcattttcccccacacaaatggaaaatgaacttacccacattggtagctatgctctgaaaagacccagttgagagaagtcctttctttattgtgtagttttaaagacgattctttgacctctgctatttatgacttgagatctgtgaaggcagggccaaacccctctggctcccatggcccacacaaacaaaagcgccccacctttgttccactaccacatttcccatcaggacaagtttctaccgcactccctgttttcataatttaagttgtgttctcttaaatttttcttgctcagttacagccattacctaatttacaagaggctcccattgctcttttccagtaaatcttttcccataatcatcacttctcagctgaaagaactttggtatgaatatagatgtcttgtcacttcattttgtttaaccatgaaattctggataaaagggttcaagagactaaacaactcatctggcaacatgcgcagccacagtatgatatccttctaccgatttattattttatggatgtgtgcatttatctatggcctttctcactcttaaaataattcaagacaatttacaaagctacatatgattacagctggaaagcacatcttaagtgagtgaaaaaaaaatgagataaagggaaattaaaatggggagaaaataaatactgtcaaggataaagcaagtttcctaaatacatatgatcaatttcagcacacttgttaaagacaggctgtttgatttaagttttagctttctaaagaccaattgtaagaggaaaacactattaactgcaaaatccacagtatccataggccaaaagtatctacccatttctcaaggaggcacaattagtactgataatgcaatcagaatgaatgtctctaggccaggcatggtggctcaggcctgtaatcccaacgctttgggggccaaggtgggcagatcacctcaggtcaggagttccagaccagcctggccaacatagcgaaacccccactctactaaaaaaatacaaaaattagccgggtgtggtggcaagcatctgtaatcccaactactcagaaggctgaggcaggggaattgcttgaacccaggaagtggaggttgcagtgagccaacatcgcgccactgcattccaccctgggagacagagccagacttcgtctcaaaaaaaaattaaataattaattaattaatatctctccaagtttcctccccaaaatggcatgacataagagaccaatgtcctcaacaactttcttagagcagccccaacgactaggtttgtaggacaatttctgaggttatcatccatattgcattgcagcaacttaccattcagcaaaagccatttgttaaaggaagatttgaaatggcaaagacatagcttagccgtgtaatcaaggcatagattctagagcacctggaagtgatacatccatcaggcaggtataaatactgtctctctccagtggcttttggtaccaccaggatacgatgagtttcatattctactacttggaaagttccagatgcctggtggctttgcttatacttcattgtcacttcatagctagcaaaactttcattagctctgacattcactgtgaaattaaaggtcctaacagacatttgtctaaaataaataaataaataaataaatacataaatattaaaaaaaaaagcaacccacttcctgcatagatatgcatcaaatagggagaagggagtatctgacaaaaatcctcctcagaaaacgtgatttcattttccaacccagaagaaaacagaaggtgtaatccagtaaacacacacacacacacacacacacacacacacacactgattacccaaagaacatcatgttttgagtagtgaatcttacaaggatattcttagacctaaattagttggaaaataaatatgccaaggtggttgaatgtcattatttatggggcaaggcaggttcttccccattgaatagataaaagatctcttgagaaaggcaaattgttttagtttcaaacaattagtctatattctctttttcaggcaagtgagacagcaagagtttctatgttcacccagttggtaaaaatcgagtttaaattaaaacctccatttattttcctacaatgactgctctttcagaaacacagagaaatgaaaagtttccaaagtagactacgcacaaacacaaattaggttttctaagaggaactcctatgtgtgattcgggagacaagtagacttgaacctcattccaacgattacgtataaggtggagtcaaaattatgaacatagaaaagcaaatgtggaccccccttaaattcaagtgagagttttctaccccagtagagaatattttgacagtgactgtcacggcagagataaagcaacatgatacaatctcatgttcaatgcccacaaatgctgatctaccagagactgaaatccaattctgtctcctttctcaaatataagggtccccaaacttcaatcagcattggtgcatttttccagttgccagaataaacctcaacatcttcaaacaagcggtgctcatccctgctctgcgtgctttctgatgaacacattacaacttcaaaacatctgtcagactgtaatcaccatgtaatgcatcttgactcagatggttttcatatgttcaaaacagattccctttctaaaggcagctttatggaactcgtcttcaactgtgaaccaaataagagatttcgtttgcattttctttcatcagatggaagaagaaattaatcgtaagagattagggaaagacttacacggaggtgcatttccccttccgcatgtttttcctttgaagtttatagcaggtggaagagtctttcacacccgtaaaattgacatggaaaagcagaaacacactgagctattaacttgtcacatattggatttaaatctaaataggaacccgttctttcccttatatattgattgtgtaccagcttagcaggaagctttgcatgttctttcagcagacaggctagtttctaggctaaaataacctggaatgtttcagctaccacaggctaatgatcacccaaatgcacactaatatgtttgataaaagttctcagcgtgagggcagaaaacgcttaccatgagaatgacagtggtcaggggaagcaaatcagtgacaccaactcatgccgccttcaatgctggaggctccaattagaactgtgagtctgcattccagggggcagtgacagatggaagtttgcagcaaatctctaattgtttaaatcattaactcatccatccacctgcattatcactagaagggaccctgctggaagccttcagtggtttctcaaaaatctcaggactatttcctggccatttaagaaatggtgttttgaaactagttgtttatgtagctatttgtgagttctttttttatctttttcccaggctctcatttttttctcttcttttttctttccatttctgcctttgcatcagagatgatagccactttaatgtccttctagagcaacaatggatgaattacttataaatcatgccacacgtccagccctaacttaattttcaattccatcaactcccttaagacagacttcaggccggtctccgtggctcatgcttgtaatcccagcactttggaaaggccgaggtgtacaagtggcttgagctcaggagttcaaaccagcctggacaacatagtgagatcttgtctctacaaataataataataataataataaattacccaggcatggtggcacatgcctgtagtcccagccactcaggaggctaaggcaagaggattacttgagcctgtgaagtcaaggatccagtgagccgagatggtgccactgcacttcagcctgggcaacagagcaagaccctgttgtcacacacatccgtgtgaagaaactaccaaacaggttctgtgtgagcaataaagctttaaaaaaaaaacaaaaaaaaaaaagagagagagagagaaagagagagagacttcatgtcttactaagcacaaaacgccaaggctacttataattatcttgtggcatcatgctataggacagttggagaaatttacatccagtggtttatattaatcatgctaatataatattgtacataagatggctttttcaaaagaacactagttgaaacctcacacacactaacaatttcttttcgcatgcattctacacaaatgttaagaccaaaatgttggtttaaggaaataatagaatatttctcttatctcttctaatgtttattctcacatcatatttattttctcctgaaaaataaagacatgatctcatgtaagtaaagacatgtacttgtggaaataataacattaatatccaaaatgaaggggaattaattatacccgacttgagacattttctgcacaaatctctctctttgaattacacaagcctgcacttctcctgaaatcattgtcaaacgtgatttggctgtgaagtcattgtttgctccaaaggagatcaataagttggacaacagatgcttggtgaacagcaacattattcttgaaatgtatcatatataaagtcaagagatattgtataagcatcagtaagtattgcaacaggtctaaagtatctaaacatttaaaattttgatccactacatattagaattgcaatcagataaaaaacgttcacctttggttcttgggtactggggcatggtgcattttcatgtatgtctgagttttcattttgctcctaagaaatgtcttccttgggctctatggatttacagtcattaccacataaatcacagaaagcatctcatacaaaacaaaaatttccacagtcatattcagatgtgtttcagaggtttggccctcactcgataaatttcacagatggcaaatgaagctgtccagatttttacacaagcaaaaccaatcttcctcacctctaaacgtggttctgaataaagctggaaaatcactaacagttaggagttgtacccttataagaactgaactcccactgagattaaagctgtaagccaaggcaccaagactgggccctaaattaccacttttcaacacatacactccaaaccaaatggggaacaaaagtcaagccagtgagttctggcactcaaaggcagaaagataagcatgcaggctccccacagataggtggttgttactaagtggcatgccattgtttgttagatgcaaggttttgaaacataactctgagctgaaagttaaaggagaaatcttttttttttttttttgagacagagtctcaatctgttgcccaggctggagtgcagtggagcgatctcagctcactgtaacctccacctcctgggttcaagtgattctcctacctcagcctcctgagtagctgggattacaggcgtgcaccaccacacccggctaatttttgtatttttagtagagacggggtttcaccatgttggccaggctggtcttgaactcttgacctcgtgatccacctgccttggactcccaaagtggagaaatattttataaagtgaagacaagactcatgcaaatatcagatggaaatgtaccaaagattttatttaactcaagaaatagtcatatgttacatttgattcaaaggaaaaatcccatagataaatagacaatagacagataaatgatagacagattaagatggatggatggatggatggatggatggacggatggatggatggatgaatagggtcaataaggaatgctggtgctgaaatggatttacaaatatatgcaaaatgttgtattcctggatgaagcatcaagtgcattccactagacaaaatgtatttgcattttcatggacaagagttattttcattatcaattttctaccatttgcagagtgggaaaatagttcaaagcactgaacactggacagaacttggagaagtgcaatacagagaaaaataatctttacttttgccaattttcaaatctttcacaatttttcttgactctgatcatcacattttaacactggattttcaaaaattagctgtgatttatttgaagtttttttttcactattgtttactattcattatttcaaatccctgcagtttgacaaacaatgttctataagctatgtcagaaactgtccatttttgtttgactttaaatattttaagatatgtctttgtattgtcagaagaatgcatttttattgttttgtttgggtttagttttgtctgtgtgaatgtaatgtcatagaagaggggttgacaaactacagcagcaggccaaatccaggttgccatctgtttttgtagaaccagtaagctaagaatggttctttcattttcaatggttggaaaaaaaataagtaaaatattataatgtaaaaattacaggaaattgaaattttactatctacaaaaaatgttttattggaacatagccactcttcttggtctatgtattttctactattgcttttgtgctgcaacaacagagttgagtagttgcaacagatactttatgggctgcaaagacaaagatggttactatctggtgtttttttagaagtcatttgctaacccttatcctagaacactgcatttaatgaaaagttacattgaaaaggatgatgggattcaggacacactactcaaaatacggcaccttggcatattaaaaaaacagaagcaggaaagtctctctgacctcccctcctcacccacacatatgcttctccccgatgcagggcatacagcttaggaaagcttttccaacattcccaagaagcaggtcagaagacactcatgtgagggcctcccgatccctggaagaaaggaacatgctcatctctgaagatgaagggtcacagagaggaacctgaacaaacaggccttgctaaattccccagtttatctacactagatcacaccctttttgtcctatcatatctctccatcagtattcactcttcatcaaagctactataaaaatacacagaattaaccatttactggagtcttcatttatttaggaagactcccacagcatgtaaatcttactaaataaatttgcaagtttttctcttcttagtctatcttgtgttaaaaggacctaagtcatgaacataggatgggtagagagaaggatatttgtcctcctctaccagaaaaagccactgggaaacatagatgttaacatggctcattacaatattttgactctgtgctatgactaaacaccagggcatcttgcccatgaatttgaatttcctgtcaaatgctccaaatcattcctaagtgggcttttagggaaattacatacaatgaaaaatagaatgtaagaataagcatttcctctgagctggaggctgtctttggctggatatatcattgcttcaggcctcaggttcctgaagcgcacaatgaaagaattgcactggatattcctaaatattctctctagctttagaattcttctctccatccttcatgcaaacaatgatctcagtggtctgtatcacctatgttcccttactgagaggagccatctaactcttaacatagtcagtcctaggatccatgtgtctgtggctcactcaaatagttttctctttcttcatcaaatatttccatcccagagtaccaaataagttacgaacatgagaattgagccttaagaccatgagcagagcctaacagaaactgggtaattcacatattaaccgttaatgggtgagtacagaggaacttcagaatgatggaaaagagttagaattgtgagattagcaaagagaaaaagcagaaatggattctaaaggtacacaaatgctctaatgggcaaagtaagggggagaaggtggttatgtccccattggtacagtaatggggactcataaggaatattgcatgaattttttttttttttttttttttttagacagagtctcactctgtcgccaggctggatctcagctccctgcaaacttcacctccagggttcaagcgactctcctttcgcagcctcccaagtagctgggactacaggtgtgcaccaccatgcccagataatttttgtatttttagtagagatggggttttaccatgttggccaggatggtctccatctcctgcccttgtcatctgcccacctcagcctcccaaagtgctgggattacaggcgtgggccaccgccccaggctggaatattgcatgaatttttaagaatggatgaagtaacaatatctgggaattttctcagtgagcaaaaaagtaaaaaattaatgcaaagaccaagttcacccttcatatcactttatcactagggcctagggcatagtagatgctcagtgagtatctactgaaatgggattaatcagactctattggaacgagcaaatgaaatgcatttaaagaaaatgttaaactagaaacataaataaaagggctgaacagccacaacattataatatatgggaaaaaataggatctgatttacattatatttggcatggagtaatttgttatttaagagaaaggttaatgaaaataggttcttaaagtaataggtcgggcatggtggctcacgcctgtaatcccagcactttgggaggccaaggtaggcgaatcacttgaggccaggagtttgatgccagcctggccaacatggagaaaccctgtctctactaaaaatacaaaaattagccaggcatggtggggggtacctgtaatcccagttactcaggaggctgaggctggagaatcacttgagcctggaaggcagagttgcagtgagccaaggctgtgccactgcactacagcctgggcaacaagagcgaaattccatctcaaataaaataaaataaaagtaatgtacattgttaagattggaccaacttaaaaatattattagaatggaaatatatcacgttttatcagtatgttttacattactatagtaatatttcattccaaaaagtatttagtgtggcttggactgaaaaaaaggaaattaagataaaaattgtttgcaaaacatatttagatagaatttttaaaatacattattttttatgccaaaggtgtatatttactttcttgattagaaataggtgatcttattacttacttactactaaaattgaactactaaaaataagtgattgtaaaggcatctttttaggatagatttgatatattttaaaaggcttggccaggcatggtgactcacgcctgtaatcccagcattttgggaggctgaggggggcagatcacttgaggccaggagtttgagaccagcctggccaacatgtcaaaaccccatctctactaaaaatacaaaaattagctgggcatggtggcaggtgcctgtaatcccagctactggggaggctgaggcacaagaactgcttgaccccaggaggcggaggttgcagtgagcagagatcatgccactgcactccagcttggcacacagagcgagattccgtctctaaattaataaataaatggtttgccctgaatcatccgagactgaaactgtgtttagatgtcagttttgcgaacagtttattctggagtggccaagggcataccacattcttatgggttaaatgttctctcaacataaaaaataaagaaaagaaaagaaaaatcaccttaacggaggaatatctaaggaatctatttctccgggaatctactatgtatccctaaatgaagctgaatcagaagagtaggccatctttaggctgtatctttctgacttcccaccagacaacaggaacataaaagcaagaaagagaaaatatggctcatttgctagaattgggtcacagttttgccaggaagttacactattcacagtagctataagggtggaaaaaaaaaaaaaaaaaaaacctagtgcatcaagacaatcaaccactaaattgagcaggagatctttcataacttttaaaaagttattctataagacttcatatgtgtgaggtatacaatgagaaaatcactggcttttaattccaccggaactcagttcaaatcctgtgtaggggatttactggtacttattagtaaagtgactttgtaagaaagtcacccaccttttctgagcatctatgacatgaaggtggtcattccaagatgaagccgagattaatttcactcacacacaattccatcttcatagaacaaaagaaatgtgaaataacagtaacttaagcaagatagaaaggtatttcctcttcatgtgcaaggctggtatggggccccacagtatcaaagagccaggttccttctatctttcttgtcagttattctcagcctggactccatcctcaaaagtacctcatggcccaagagagctgctggggcccctgccattggtatgccctctaagaagcagggaaagacaaggggaagagaacaaatgagtgcattttctagctaaatcagttccctttaaaagaggcattttgaaatttcttcacaatgattccacttgggcaagaaattagttactggccatatttagaagcaatggagcttggggaaatatagatgtttaacacaaggtgacaatgtgctcaggtgaggaatgagctttcgattagcagagaagaggagaaaccagattagcaggcaaagagcaatctctctcaccagtgttacagagtacatgatgacaatcagaattcctagacataatgagcccctaaaaaggtgcttggcacataccttgtactcagtaaactacacatttattttctttcataaataaagtaaaactgctgaggactatgctcttaatttcttttataacttcacaaatgtgtagaccagagtttgtcaatctcagcattactaatatttggagccagataatccttgctgtgggagggcttttctgtgcagtataggttctttattagcatccctggccttgacccactagatgccagtaactcctcactcccaactgtgacaatcaaaaatatttccagccattggcaattgttcctgggggaggaaattgcccttggttgagaaccactggcctagacctgtgctggacaataggcactcttctatattctctagggttgagtggtgcaggggctaaagacccttgagctcatagtgctgattccattatgtggaacccagcatacccgaagtcagatgaagcacagagacgaatctctacagttaaaatgttttcttccagcctggccaacatggagaaactccatctctactaaaaaatacaaaaattagccgggcatggtggcaggcgcctgtaatcccagctactcgggaggctgaggcaggagaattgcttgaatccgggaggcagaggttgcagtgacccaagattgcaccactgaactccaccctgggtgacagaacaagactccatctcgaaaaaccaacaaacaacaaaaacaacatcaaagttggggacagagcacaggcagtcaagagacagccagtgagaatcagaatagggctttggattttagtctgagtgagacggaaatgaatcattaggtttaaggtagacagcagtgtgatgccacttatatgtttgaagggtctttccagcagccatgaggaaatgtgattgtttggggtcagagtggaagctaggagacccatcgggttgctcttggattcatcccagacagagagaatggcaggttggaggtgggaagagtggttagatgagatctattccacaggggctctgaaggaggagctgacaggctttgcagatggtcaccagaagtgattaaaaagtgtgtggtttctagaaaacattatgcaaacctaatcttttaaaatacatcatcggaaaattgtagcattaacactgcttctgacttttctgagttttctgacttttctctccctatatttgtacaaactggtttctagagttgttggcctgtaagaaacacagtgtagaagacagggatgtatatgtctctactggtttgttgagtgattacagaaccatcatcaatatgcacatgcctgaattttcccatttgtaaaactgatgactatgtgactacggattaccagtaaccttattaacctacgcattaagagaaaaagcccacctagtacttcatgaatcccaaaagaaatgcaaattgtaattatctgcacaggtatccagtcatgctaacatccaaaggagtcaaactctgattaataagcaagattcattcccaaagattcccaaggatcccaagttaaagacaacccttcaatttctgtcagctttgtaatatattccagagtttcagttgggcttaattgtgacttattgattgatttttgctttctgacaaaaaggattgctttctttccttgtgaaattcaaagtccctcatggcagccttgattaatcatttgcaaaatatggtttaaccatctatgatccctagtgtacaaatttctttcactgcaataattttaaagtaattcaaataagcctgttctaatcaaattccttataagtctgcaaaagataatttcttgatggaatatggaaaaaatgagtgcttaaataagaagtattaccaatgtaacaaattatcattcctataatacacgattaatacgacactgcacaaaaagaatacttatgaaatttaatcagcctcatagcattatgtgctttatctggaatgatggcatgaaaaagttatctaaaattccagttgaagaccaattaatataatcaataccagaaaatgtctggacagaacaaatgcttaggacattacataaaaagagtaagtggaccgtaaccaggcatttcattcctgcctagtatctagacagtcagagataagcaaagcttatcttcatcaaattatttaacattcacgtaggaactctgttctattttaaagtaacactcatgtgtattcagtgagcatgattgtggaaatgcatcattagaacaaagtttttggtttaggaatattattctataataatttattgtatgtatttgaaagacctttcacaaaataatccttttcataaatatgctatttcaagattattatatattccttagattacttgttgtttataaaataaggtgtacttctattttaggactaaaagtaatatccatgaaatgaattttatgaaacactattatgatcccaaagttttgctccaatgtttttagcaaactttgtaaactttactcatttacataacctgattacgaaacctacttcagactggagctagagtaccatcatatatatatttaaaaaacaaagattttggtgtattgggattgaggtaagaattgtattatatcaaacatataaataagtaacataataaagtttatagtactttagtgtgcagcaaagaatactcaaaaatggaagagagactctttaatgaaaaaatcaaattatttaaccagcaattcctacaaagaaaccaaaatacatgcaaaataacataagtataaatagaatacattaaatcttctctggtctaaccagagggcattttcttcttaatgttttttaacagaaaattacaaacaacaataaaatacagtagtatatagaaccattgatacctgcatcttgatggcagtggtagctacgtaaatccaatcttacacatgataaatgtcacaaaatcatatacatacattgcatgcatatcaattttgtgcttttgatattgtttacaattacttaaagtgtaaccattggtggaaactgggcatatatgatttctctgtgctgtctttgcaacttactgtgaatctataattattccaaaattaaaagttttttgcaccattcatacaggtataggaaacgtaccttagaacattgcttgtgattctggcaccaaaccagggaaccattgttctgcaaaaagaaaaaggaaaaatattgatccattagaaagctacacatacacagatttctaatttaaaattataatttatgcatataatttttgaatatttgcattttaacaaatacccaatcttgcaaaacctgctgtccttcccttccaatgatagaaaatgtgtttgtaagtttcattttgttgtcgatttcatgatgtaaacaaagacatataaaatactaaagattctaagctgtctgaaatgaaaaagggtctgaggcaactttgatggtgtgttgagcagtgaagcaggtaaatgaacactagacgttccgccaatagtcagcagttttgagaaatttacaacttaagcattgtggatgcttttgatctcaaccaatttacagaaataagagtttgggattgggagaaagatcttgtattagtctgttcttacacttctataaagaactacctgaaactgggtaatttatgaagaaaagaggtttcattgactcacagttctgcaggcttaacaggaagtatggctggggaggctcaggaaacttacaatcatggcggaaggcaaaggggaagcaagcacatcttaccatggcagagcaggagagagagagagagagcaaaaagggaagtgccacacacttttaagccatcagatcttgtgagaactcactccctgtcatgagaacagccaggaggaaatccacctctatgatccaattacctctcaccaggcctgtccttccaatttgacataagatttgggcaggcacacaaatccaaactacatcagatcccacgtgaaaagccttctcttactctttcacaaaacatatgattacagacaagagacttaacatccccatgcctcagtttatccatcagtaaagcaagcctaacagcaatatctcatgcatcaggccactggggtaactaaatgaaacaatagatacactcaatatataacaaatatttggggccgggcgtggtggctcatgcctgtaatcccagcactttgggaggccaagacgggtggatcgcctgaggtcaggagttcgagaccagcctggccaacatggtgaaaccctgtctctactaaaaaatataaaattagctgggtgtggtggcacacgcctgtaatcccagctactggggaggctaaggcaggagaattgcttgaacctaggaggaggaggttgcagtgagctgaaatcacaccattgcactccagcctgggcaacaagaggaaaactccatctcaaaaaaataaataaataaataaaattgtactatgatttattatcctgaacattagaattgctgtattccacataactaagattttggtgatttttttttttctctggttgggatcttttaagtcaggttatgctaggccggaataggtagcaaagctagcagaaaccatcacccaatagctaaaatgtcatgacctctagttctctgaagttcaaggtggagatgaaacaaaatctcccatttcctatgtttgaacgtctaaacttttaatatgaaggataccagtattgacagagcaagatgatatatgtttgcagttatgagaaaagaaaattgaaccaaaaaatatcttttagaaaatacttttataacaagtttattgagatataattcacaaaattcactcatttaaattgtacaacttgagtatattcagaaagctatgcaaccaacaccactatttaattgtagaacattttcaccagcccaaaaagaaacctgtacctatttgtaatcactcccattctgtcttccccactacttgccttaccctggcaaacactaaatctgcttctgtctttatctatttgcctattctggacattttatataaatggaatcatacaatatgtgtctggcttcttgatgctaaatgctacagcaatcttgcttcatgtacattgtagtatatattggtacttcatctttttgactgtcagtttcagctacatggatataccacattttgcccatccactgccaataacatatctgaatatgtcccttcccagtaatagcttaattataggatcccccccaaaccactaaataaatctcagctgtataggattggcaatcttcttcttcaatgtgaagattattggcttaaaagatctcggtcccatatgaatgctttaactatgaaacctctctagcatatagccctactttttacttcttctcagccttaactcctaataattcctacacattcttaggattttagccagccttaactcccaataattcctacacattcttaggatttgagccaatctcctatgaacctacctaccacctactgagttccgtacgtccacatctgggccctcatctctccccccacatctatgtcccccatagagacagtaaggtctgaagctggagacgcatacgaacagcttagggtgaagttcgttatgatttttggcagggattacatcagataaataattagattgggcagaggccaatgccagacaaatgatgggcgtggttgaattaccggaaaatgagatgttaggagaaagcatgtaagagggcataacatacccttttataaaactgaaattttataaagggagccattggcttggttataagctaaaagttcagaggggccaggctgactaggggatggtcataaacagtgtgacaactgcaaaaagcaggggccaggcattgagcatgcagaagctgggggctggggcagggcagctttgaagaacttcctacatgacagccagcctcagcatgttgcacggtgtgtagattcatacaggattggctaaaatcctaggtatgtgaaggaattattgggagttaaggctgagaagaagtaaatattagggctatatgctagaggggtttcatagttaaagcttcccctgcttcccctgtgcagagttggctcctgccaggacttccaaggacgacacctgtctgagcacatcctggattcaacttgagtgttccaagctcctccccaaccagtgatgggaagcaatgaggcaccttctaaagagactcagggctgaagtggacagcctcagaccttggagactaggtcaaagccagttcctgaaggtctttttcagcaccatcttggttggaaggttttgagtcttcttgagtcaggtcagtggggttctgctccttggactagaatccttgacatgggcacaggtgagacctccttcccttctggatgtttcttttcctaggcagatgggcaggaccttatctctggatgagatcaggggaccctcagctatttctgcacttgctggattcctctttggagttttatcacaccctctcctgctgaatgatatgctttattttgtctgtgtcttggttgctcaactagatttttccctggggacaggattccatgtttcctctttacctgtctgtaagacattagcaagggagggcagctcttggtcctcacagagaaggcacatttctgaggccatgcaagagtgactggggttccaaaagtgggcatggcaactgttgcctggggttccaaaagtaggcacagaaactgttgtcaacaggttgacaaaaatatcactaacgcggcaatacacctttgactattattattattatagtggccaaatctatgtggcagaaatgtgccttgatgttttaatactcaccccatgtaatcatcccacaaaatgacataagcttcatttattcattttacagttaagaaacctgtagtcagggaaaccaagtaaaatatgcagagtgacaaagccagtgattaacctcaatggtaaacaacacaacaggaaaagccacaggtgaagaaaggaacaagatgcacactcgattttgaaggaatttccagatttataaccttaaaaggagagatgaagattggtccaacagtcctaaataccatatgttgaggtagcagcagttcagatggatggggtggagcagagaataggaggggagatcaggtaaatagaaagtagattgcaggattttcattacacaagattttatctctggaaataatatttttaatttagcaaatatcagagagttaattaaaacaaaaataaaggattagagtcctgagaagccctgtgcaggacacaccttgatatggtttggttgtgttcccacccaaatctcatcttgaattgtagctcccacaattcccatgtgatgtgagagggaccctaggagaggtaattgaatcatgggggcgggtttttcccatgttattctcgtgatagtaagtctcacaagatctgatgggtttataaagggcagttcccccgcacatgctctcttgcctgccaccatttaagacatggctttgctcctcctttgtcttccaccatgattgtgaggcctccccagccatgtggaactgtgagtccattaaatctctttttctttgtaaattacccagtctcaggtatgtcgttattagcagcatgagaacagactaatacacaccttgattagctttcttttgttcccttctactgtgtatgttgaatggccaaacttcaacaacaaaagcacaaaggatgcagcagagattgtcttcagctgcccaacctccccttcccaagtgtaaaccctcctgccctgccccacaccaactctccttctttcctgcaattcaatgctccccataccattggcttatacacacccatcaaaatgagaagaaagccaatagccacagagcctattttgaattgggaattaatatcaatacattgcgttgagcaaggcattttcatttcaagcaaaattttctactaatcacaaaatgaaaaactctgtcattacaaagaaatatttggggcaatggcaagcatgcataaacaattattatgattagaatgattttttaaaattagtgaggacagcatgtcataggctgcttgggatgattaaaaagataatccttgtaaagtatttatcaaaatgtttggctcaggatttttaaaaaatcctttgttattattgatgtgattttgttgtcatttgccattatattgtctttagcagtttgggagtaatcctagacttaatatctcccagctcacaacggataatactcaccctagactaactgattcagtcttattatagtgagactcaaaagtatttagtattgaaaatactaagatacagtattttagcaatactaaaatacaaataaaacttgcagtaaaaggatgcctttccattctgttttttccttgggtggaagcaatttttcaacatttgccaacaggatgagtgggcaatggtattggtatttttactttaatttcctgactggccatttattttcctttaccgtggatagtctgtctcttttaccttatctaattgcggattgttcaccatttttaaaatcaattttagcaactattagtatcacttaggttcaatgatcatttgtctattgcaaaaattctcaagcccctcattcatcttttgcatttatttgtgaggtttttccacaaggaaattttatatgcatgcacacacacagatgcacgcatccatgcattcacatatatatttgccctcaaaatgcatccatagttcctttttggattctgggtttcctgtttttcttaaaataattgcccccatgccaaggttttgcagccgttctgtgcttttacctgtatcagtcatcatgtgctgtgctatttatctctactaagaacttctaagaaccctgcccactagcatcagggatgccaataaacccccgattaatgctggccactttgtttaggccagatgctaccccatcacgatccacctatgttgcttacatatagtactctttgagcagaagagcaataaaaaaatacaagaatccagtatatttcaataccctgccccagcagaagtccttcgtcagattacaatagccttcaccagttaagccatttgacaacaaagataaaataacagtatttgcaataaagtcttgttctggcttaaagccaacaaagataaagagtcaaagtacattaggctagaaacacatttgcctctagaaccatcattgtaacctccaggtaggattagacagtgggacttttgtaattatataaagattacatcctgtattttattggtttaactagatcaaacatgaatgctagtcaatctggctttcaaagagtttatataagttcaatcaactgcacccagccgttatttcaatgacattttccaagtcttttcatttctagccttttgatttttccttaaagaaagataactcttcaaaagcttcaagtaaagaaaacacatcattcatgcaaagacaacacacacgggaagaataaagataaatggaaactagttctctagatcccaccatatgaaaagagaaaacaggaacagatctcactcatttccttcaacatagccaggtgtcggcatggaacagctaaggaactagtcagtctacaatttccaaaatacataccaaactagtgtctaacaatggaactgaacatttgaaatagaaatcagtcaggaaacccaccatagaccttaactttaccaatcaatgctttgacactgcaaataattagctgtgaccctgaatggacaattttgtgtcctgcttggtgtaagttattttaaagcaatagatgaaactatagatacaagtcattatatatttgtccaaacccatagaccatacaacaccaaaagtgaagcgtatgtaaactatggaccctgatgatgatgatgtgccaacgtaggttcatcccttgtcacaaatgtcccactctggtgggggatgttggtaatgggagaggctgtgcatggtgggggcagagagcatgtggatattctctgtaccttctgctcaattgctgtgaacctaaaactgctctacaaaataaaaagtctattgaaaaggttcaggaggagggctttctttatatatttgttgttcataagtaagatttctttcaaatgttatggaatatcctcagcagtcttttcattaaccaagaaaaaagtctctctgtattctacaaatatttcacatttaatggaattctacaggaaacaaatatttgaccatatagaaagaaatacacctgcctccagacacccagccttcccatactgtcctttcttcaaagaaaatgcgacttcaaccaggaagccttccctgacccccacgccctgacttccacagctctctctctctgttgcttgctctataacgttctgcacttctccccccaggcactctatcacacagtggacaagtgcaaattatgtgtgttgttttaatttaatgatcatatgccccccagcctggaaaagctttggcggtagtgtctatccctagcacatgtttgccattggctctctggcacatagcagcgtgcctgacacagagtaaatggtcttcacaaatggtactgattgaagaaataaatgaatggagtaggaggtcatacaaaggaatttaagctttagttattaggtcctgaggagctagaaagaatgatataaatagactgagctgatgaaatgtttcatcttctctggatggagcttttaagaagtaggctcattattttgtttcctatgatgtaaatgtccaagagatttggcatgatgacaccgaaaactgaacaaagacttgcatttgggatcaaatatacgttatttaataaataaaaatactaattatctttttatagggtgtagatacagtacctaaagaaaatatatagaacagcaaatgccagacttttcttcttctcatcattccctaaacaatacagtgtaacagctatttacatagcacttacacagtattaggtattataagtaatgtacagatgattttaaatatataggaggatatttgcaggttatatacaaataccacaccattttacttcaataacttgagcatcttcagatgtaggtgtctgccggggtggggaggggaggcagatcctgaaacccttagggtgcattataactttgatatacttttcctgaaactaatagaattgtgttcttcaagtatattcatccaagaagaacatactgttgtttcaatgtaaccagcagttattttccacctgtacttttaaaaccaactggccaggcatggtggcacacgcctgtaatcccagcactttgggaggctgaggcgggtggaccacgaggtcagtatttcaagaccagcctggccaacatggtgagaccccatctctactaaaaatacaaaaataatctgggcatgccagcacatgcctgtaatcccagctactcgggaggctgtggcaggagaattgcttgaatccaggaggcggaggttgcagtgagctgagatcacaccactgcattgcagcctgggtggcagagcgagactatgcctcaaaacaaaaacaaaaacaaaaaactttagggggaagctgagtgccagacagtttaaaggaacaatagaaatgcctaagaaactatcatcagagtgaacaggcaacctacagaatgggagaaaaattttgcaatctatccatctgacaaagggttagtatccagaatctacaaggaacttaaacaaatttactagaaaaaaatcaaacaaccccatcaaaaagtgggtgaaggatatgaacagcacttctcaaaagaagacatttatgtggccaacaaacatatgaaaaaagctcatcatcactggtcattagagaaatgcaaatcaaaaccacagtgagataccatctcacaccagttagaatggtgatcattaaaaagtcaggaaacaatagatgctggagaggatgtggagaaataggaatccttttacactgttggtgggagtgtaaattagttcaaccattgtggaagacagtgtggcaattcctcaaggatctagaaccagaaataccatttgacccagcaatcccattactgggtatatacccaaaggaatataaatcattctactataaagacacattcacacatatgtttattgtggcactattcacaatagcaaagacttggaaccaacccaaatgcccatcagtgatagactggataaagaaaatgtggcacatatacaccatggaatactatgcagccataaaaaaggatgagttcatgtcctctgcagggacatggatgaagctggaaacaatcattctcagcaaactaacacaggaacagaaaaccaaacaccgcaagttctcactcataagtgggagttgaacaatgagaacacatggacatagggaagggaacattacacaccagagcctgtcagggggtggggggtgaggggagggatagcattaggagaaatacctaatatagatagatgatgggttgatgggtgcagcaaactgccatggcatgtgtaaacctatgtaacaaacctgaaagttctgcacaggtatcccagaacttaaagtgtaattaaaaaaaaaaaaagaaagaaaaagcagtacatatacacagtggagtattattcaaccataaaaaaagaaatgtctttaagaaaacaaatgtcaatttcatttcaaagttcttgtgaataatgaaaatcatcaaaggagaaaattatgcaagaccaacacagagagaaaacaatattaaataactttacatgactttgaattacattgttttcttttcttttctttcttgagacagggtctcactctgtcacccaggctggagtgcagtggtgagatcacagctcactgcaaccttcgcctccagggacattcttcaccatggttatctgcaaagagtatgacatgatgcgaatatttatctggctatagtgtactttaggtgatacgtaataactagaagtgttttgaagccttcttaggtcttgtatttccttaactgttgtaggtgttgtgttcttaatataggatgttttataaataaatataactaaaaattcatcaagaaaaattttagcagaaactaaagttgcatagactaaaactatgacttgcgacatttcttagctacatcaggattcaaccttgtccaccctgggaaaggtagtgtgcaatagctgctcttatgcacaaatgattgaaaaccattatttgtgttatcttataatttttttttatttttttgagatggagtctcgctctgttgcccaggctggagtgcagcagtgcaatctccactcactgcaagctccgtctcctgggttcacgccattctccttcctcagcttcccaagtagctgggactgcaggtgcccgccaccacgcctggctaattttttgtatttttagtagagacggggtttcaccgtgctagccaggatggtctcgatctcctgacctcgtgatccacctgcctcggcctcccaaagtgctgggattacaagcgtgagccaccacgcccggccgtgttatcttataaatttatgagggcttttgaaattccgattttatagttaaccacatgagccacataggagtccagagctctctgagaacttctacctcaccagcagtccttctgtgcaaagtattttcatcaatgggcattccggtctctgtcaaagtgtaagatctatttgaatctgaccaagcctgttctctaaacacaaccaggataagaaaaaggacccaacaagtgattccaaatacccactcaaaatgtttgtaaatggtagcattctgactcagatgataccatatcattacaactcagagaagatctttgagggccattcaatccatcttcttggtgaaaacaagacaaatgtaactcgttaatgacatgtcattgtctcataatacagggaactttccaaggaaaagaggttacagtgtccctgtaacatgttactccgctatgctgacttttccatcctgaattcctagcgaaatctctcaaagccattcaagggaaaaggggtgaggagttgcaagtgatcaactttcagattttctgcctgctaatattttattctctgattaactaattcatctagtaactctctccaaaacatttaccatgccaaaggaaaacatcaaaaccagaagagaaaaacacaatgcagggaccatcctgcctgagtgtgaagaaggaagatcacacacatattactgaattccataatactcaagggcaggaccaagacgatgacacaaaccacatcatggaaatgagcatatagtggggaacttagaatttccactaatgtctgaggagaaaggaaaagcaaagaatggggttggaggagaaatctaagtgtccaataaacctcaaaattaccatgctgaagaggaatctaagtgtccaatgatagctctaaacctcaaaattaccatgcctaagactgtcccaaatcatcaggttagtcattgtcacacatcagaataacatgtgaaagccactggcaacagtggcaacacaagagtcagaggaaaattctacatcctgagaatggcaagttaatagcaattcaagttcaacagtctccctttgtagatgagtcaattggggctcaggaaggctaaaaaatgtatgaactattactgattcaaacacaaagaatattttaatagtaagcacaccttacttaaagtcaaaggctttatttcacatgccaggctactactcatccaccatgggtggtaagctctcagaaaaattaatgtcttcttttctcaaatgagatgaataatgtctttacaagataatcacagagatgtctatgaaaaccacctgtgaccatccaaggtcaaggctgtagtctagctggcaagatgccaagttcagtgatatgaccactttgcacacaaggagtgactttcaataacgtagaaggtctcagagagctctggggccccacctggaggttgattaatcccaattaatcatgcgattagccatggagaagtcagaattctaaaatccctcagtaagttttgatacaacagtaaagaaaatggtttccagtgccttataaataagagcagcctaattaatttctacattgtatggttgtttcaagtctttgcaaaggcataatatccatgtaaagaatagaatctatacagttgtttaatgcaaggtcacactaaattagattcacatatcaaaaccccacttgggagaacatgaaaatgcaatactgtcaagtgctattcttagtataatttcaaattcacattgaaatatatgactttgtttcctacggctgccatgacaaagtaccacaacccagggggctgaaagagcagaaatttattgtctctcggttctggaggctggaagtgtgagaccaagttatcgcaagaccatgctctctcagaaaggccataggggaagattggctccatgactttctttgagcttctggtagttccttggcttgtggcagcattccaaccttcacatccgtgtcctcacatctctgcatgtctgtgttaaaatttctcctttcagtaaggacaccagtcatattggattaggggcctaccctcctccagaatgactcatctcaattaatcacatctctaacgacgttatttccaaataaggccactttgtcactttctgaggaactgggggttaggacatcaacatatggagttagaggtgcattattcaatccggaagcgactaaaataaattaaagccatgggacaaatactacattgtttcagccacacttcaacctgcacctcagttaataatctatgtgttaatatgttcacgtattattttttcaatttgcttcaactcactatcaatgtttatttcttcactttggcctccttgccatctcccagcaaatgtcagaacatggtgttttgtaacaacccatctgtccatctcactgacaatggtttttcctttcataaagtacttcaatctgacagcaagtgggtgtatcataagaaggcatttgtaatccataatgtaaactgtttagaatcaagtagtccagttttggtgaaaattgattgcttgaataaacatggaagaaccacaccgtcataatgaggtgatttggccaagcacacaattctccccaggtgtaaccaatctacttttaaaatgttgcaccctctggtgagaccttcagctttatgttcctgatctttgttccatacctggaccttgattactaatgacccattctctcccaggagacccactctctctccctgaacacatatgttcagaggaattgacaatggcctcttcatctgtcaacaaggtggaatcaaaactcatgtttcaaaagacatggcagccagacagtgactccagccctctcatttgacaaatgagtctactgattctaagtgagcctataatgatgtttctgctgaggacaccaccactgacttctacttagtaagctcacacttaatcaattgtacataacctgaatcaaaaagggctgcccagaagaatgtccaagctgggggatggagaatggacagttccaaagctagaacttggcacctcttatcaagcaaagaaaggtaccagagagaagcccgacagcatgactgactgaagcagtgactttcaaagtgtggtactggaaccagtgatatcagcctcacctggaagcttttgcaaattctggtgatataccttacactcgtagaatcaaaactcctggggctggagagcagtcagctgttttacaagttgtccaaatatggctgatccccacgaaagcctgagatgcttactcttcctttgctttatgtgacttcacgaaatacactccaaatgtctcctttctttcttttttttttctttctttcttttttttttgagatggagtctcactctgtcacccaggctggagtgcaacgacgcgatctcagctcactgcaacctccgcctcccgggttcaagtgattctcctgcctcagcctcccaaggagctgggattacaggcgcccaccaccacgcctggctaatttttgtatttttagtagagacggggtttcaccagattggccaggctggtcttgaactcctgacctcaggtgatccacctgcctcggcctcccaaagtgctgggattacaggcatgagccaccgtgtccggcccaaatgtctctcttctctcccttccaagtgtcccaaataaatgactgagacccttattcagctcttacaggtatcttattggattcttgtcattgagaaagaacaaccctctttgtaaagcagtaagttgatctttgcatgtgctggtttctttttctccaagaccaagactcaaggtaacaacattcagggcggtctagacctctctggcctctgctgtcttggcctcatctcagtctctggccattttcatacagaacaactgtagaaacatgtaatttcttgctggggatgactgtgtggcaaaagcacaaagcagactttaaaggcactctcaaatcaccctattatttttcaaaatagatgcttggcagctgcaaagcttgacaggtgcaatatgttatacataacaagtcattcccacaaggcacattactgcctggaatctggcatgttgaccagcagaggttaaggattaatgttaagttatcaagctaattactcacatgcattaagagtaggtggagaggatatgcttccggataacatgagctgggaactattgctattatcactataaccattaaaaaaaaatctaattgaaaaaacgtaccgtgccccagagataaaaactattatttccatgtgcttccctactgaatattttagcaacacattttggaatatgcctggtaagtcctagaagttgttgttttaatggtaaagcaaaacccccatcttgctatacacatgtaaactaggagatgcaggacttagtagttgagcttcatttgtagtagggaacacccaagaaggggaaaaaaaatgactaaaaatacatgttttccccttctaattgactttactaagtgtcagatttttgtcacattgttttcttgtgatatatgctttttcattatgctaatttatgttattcattaaagagtgcagaataattcatcaaactaaaatagagtacctcatagtctattatgccctgacttatattctaacccattcatcatgattctgggttattttaatataaacttcaaaagacagtgtgttttaatgagggatcacttgagaaaacatgattaattaaatgtgatgcaagcgcaaagagcaataaccccaagaaaaaactgctttgcaaaaaaataaaactcattccaagaaaaatgtgttcattgcagaattagaaggatgtctgaaaagtcaggtatgttttcccagtagaatagatgacttggaattaaatgactttttttccttacacaatatttatccaggatttcaaatttcaatttaaaaatctacttaatcttatcctatgcatcatacggaaaggtgaaatatttctcttttttcagagacagggtctctctgtcacctaggctggagtgcagtggctcaatcatagctcactgtagcctcaacatcctgggctcaagcaatccttctgcctcagactcccaagtagcaaggacaagaggtatgcaccaccaagcctggctaattttttctttttcttttttttttttttggtagagatggggtctcactctgatgcccaggctggtctcaaattcccgaactcaagtgatcctcccatctcagcctcccaaagcactgggatgacaggcccaccatggccacccagaatgggaaatctttaagtaacaaaagcacacacgagagatctgcatgtcatgctctactgattgaactagatacttcaaaacaaactggaaagagtctcttaaattaaaaaattaagtttttaaatctcttttggaagtggaggggtctctcagaccagactgtagagcactggggatccagggttacatactattcattttattttagcgatagggtctcaccgtgttgcccaggctagactagaactcctaggctgtgatcgtccctcctcagtctctcaagcggctggggctacaggcatgcaccacactatttttgaatcccaggatcatcagcaccaggcactccctctgggcctaactcaacctgatgacagccagcgcgtctgtagagccaagtaagaggctctgttctgagtaaaatgcatggcatcccagaaaactcaatgaagcagcaccaccgtcaaaatggaggcaaagggcagtcgacggtctgagagagagggcagagacaacagtcttcagaaaggaaaagaagtttacttgcaaagaagtcccaaaaacagaagaccttaggaccagctcaccaacagaaataatgataatgtgaatttaaagaagaagatgcagcataactaagtttgcatgagtctgctcatagataaaaccatccatctacttatatgatcatgctcacatgccacgacacatcttcacaatcagggttgccaaagacgcaaggaaagtgaggttttcgtttaggagagagaaacttaacagaatgctacaaggtctcatttattcagaagatgaaaacttgtcaggctaaccctgtccttttgtggtcatctcagggcccaaaccttctcctctgactgtgaatggggatgtccatgtctcctcataagcgagagagttcacagcatcagttttgattccagaattacttacagcagagatgtaagcataggaagggacagaaccagggtagggcaccagcgatctggatccacagtgcactctggatcaccctgtaacccctcctcttgtggcctcccatctctgagctagtgacacctgacacctcatttgtgtctgtgcaccccagttccctgacacagtcctttgggaatgaaggcacgtgccttggtcatcttggcaacaccagcgcctagcaaagagcctgacacagcacagacccttagtgtttcctgagaacaagaagctaagccatgtcatgactgccaggatgtttgccatagagtggaagcaaaacatatacagatagagacagacacagagatagagacccagagacagagacagatggaatagatatggatatcccgatacaaatattcacatactgctatgtttggagacatcagttttgtcatgactgaaggtgggaggcatggtactggcattgagtagggagaggccagggatgctgtggaaccattaaaatgcaccagacagcccctccactcaacaaagaagaatctgctccaaaacgtccacagtgtcatagttgacaaaccctgaactagaaacgcatgcataatatacacacagacgaatatatggaaattaaattctagccctaatttcatgaggttatgtaaaaaagcaacctccatcttcttttcaaaattgtggagtaataaagtgaactagagtatgcaaatcttgccctattaaaaacaggtttaaaacattgcaaaaatctatggctcctggataatagaaaaatgaaaattacagatggtcgactagtctatatttgtttttctggtgattgtgatacataaccagagaatatattctatccagattttttttaaaaaatttctttgcagctgtgaaggcattagctcataactccggatacaaaaatgtggaaacaacaaaaacaaccaaaagatgttctctactttcttttaaattctggcccaatgggaaaaaaaaaaatacttcccagatgtaggccatttctggaatgatgaccactaggtttggctgtactgctttcaaaatggtacagccaaatgtcaaaatagaaagggagagggaagagggggaaagaaaagagagatcaggagagagcgagaagagagagacaatgcatttctactcaaagatatgatgggctgacctggcacagtggctcacacctgtaatcccagcactttgggaagcccagatgggaggatctcttgtggccagaagttcaagaccagcctgggcaacatagtgagaccctgtctctgttttcaaaaaataaaaactcaagcctaggcaatatagtgagaacttgtctctacaaactgttaaaaaattagccaagcgtggtggtacaggcctgtataccagctacttgaaaggctgaggtggagggatccttgagccagggagtttgaggctgcagtgagccatgattgcaccactgcactccagcctgggtgacagagtgagaccctgtctcaaaacgtaaataaataaaataaataaaaattcaaaatttaaaaaataaatgattaagcaaaagatatgatggcactatccatcaaggatatatgggacacatattttagattttaaaggcaaagttctagttccaaatgacttttctgttttgaggacacagtctcactcttgtcacccaactggagtgcagtggtgccactggagctcattgcagccttgaactcctggactcaagcgattctcccacctcagcctcccaaagcactgggaatacaggcgtgagctaccatgcctggccccaaatagctttagtagcccaaaacatggaaaagaaaatggggaacaaagtgcccaccttcaaacaattaatggtggacaccaccctaggtgacgtctttgtcccttcttgccacagatgaaatttaaaagaagcacagttgtcaaaacatgttcacaacaactggcctcccattttcttctcattctatctgaaaggagtcagtaacttctgcatgaacttggcattcatggcatcaacaggattggtttcaactctaggggccaggcgccaatgctgtggtgtggtttgtaattctgcctttatgtgggtcattcatatggcaggactgttgggcaggaataggtaacctctgatgtctggttgccatagcatctccttacagctacgtggttctctgctccttgttttaggcacaattacgcctctaggtgagcagaactctgtccactgggcagaaatgaccatcaagcgagggataaaacagcagttggcagagacaaaagtatctggccatgaagaagaaaaagtggaaatctcagcgctgcatcagaaattgttggtgcagagttctcagaaaatattcgtatacttccaattgtggggatgattctattatcactattcgttatgattgtaaaggatcttgcaatttgcattctgcgggagtcctatcagttggaaagcaaactaatgaccctgaaatgcaatcctccttggcatactggatttgttataacaacactctggacctgtccagttgatggggtgacacatgtcaatataagctgtgtattctgttaaaaatctctctcccgtattttaggcttacaggttttggtcaactttctttctggtatacacagtataacaaggagtctacatttcagaagagtgtcattacttccaacagtgtaggcatttaaagacaaggactgggatatttgtgtaagtctagatggactgtctcttgcaataatgccctattagagatttaaacaagagttaatcaactttccttgaatgaacccttcaaagaactcaacaggttctttgtcacccaggctggagtacagtggcacaatctcggcttactgcaacctccacctcccaagttccagggattcttctgcctcagcctccctagtagctgggactacaggtgcgcaccaccatgcctggctaatttttgtatttttagtagagatggggttttgccatgttggccaggctggtctcaaactcctaaactcaggcgatctgcccaccttggcctcccaaaatgctgggattacaagcgagagccaccgcacctggcccattatgtgactttttaaatggtaacaacatatctgcgttatctttataagaatcagggtaatgtgaaacacaaaattatatatttttgagctcactaagaaaatattttctgaagtattaacaacttgaaaagcaaaaaaaaaaccttatgaaaataaaaaagttataattcaaaacaaaagggtaaacagaatgtgaattaagagccttgattagttgccggattcttttcaagccttttgatgggtattgtttctcagactcccctgaggagaggttttaaagcttcggggattaaagaaccccaaaacttcacatctttaccatcttgttctcatgtgcagccttgagaattttcaaaattctttttttgaaagatttcctcattgcctaacttttatattttgcagagatgccggaaagaattataaagtgtaaacacacacacacataaccaaaacccaaacaaaaggcaatgaagcaagcatgtcaggcacactgagctcgtggaaatggctgtcacatacatgcaagctacaattaccatgcacaatgactccacacatgtcccaccaacatacacaacagcaacacagccaagaatgaggacaccgcaacttttgttgcaggcagcaaacatcccctgtgatgtcgaggactccagctgcttggaacgcttccccaagaatctcgataaaactctgctatttcattacatgcatggaaaattggataggcctaaaaaaaagcaattgacaaaaacaaaaaaagacattcttcatctgaaaaatatcaatatccatgatcatgagttaaattactatatgtaaggatttaaaagacgattcatggttttaatagtttctttcttcacgtcaacaacttgcagcaattttattaaatgtttgtccttctctccagtagaaaataattctcttggccaggtatggtggctcacacctgtgatctcagtactttgggaggctgatgcaacagaatcactggaggccaggagtttgaaactagcctgatcaacatagcaagaccccatctctggggaaaaacaaaaacaaaaacaaaaaacttaaaaaaaaagtagccaggtacgggggtgtaacacacctgtagtcccagttactcaggaggttgagggaggatttcttgagcctaggagtgcaaagctacagtgagatatgatcatggcactacactctagtctaggtgacagagggagaccttgtgtaaacaacaaacaaaaaatttgtaaagaaagtaattgttttggaggcaagaagcacatctcacatatgctggggcctcacaatctaagatacctgaaagacggttgtgttttgcagattcttattggttagaagaatgaattgggtgggtacgtgcaccaccagtcgggatggtgttgatggactgatatttttcaagccattttctatcacaccagcaacctttcaattgtcctcatctgtgcaactgtggtgcaaaactgcctccagaagccagtgagaaatcccgtcctagttcccttacaactgagtgtctctggatcataatataggtgctgtttcccctctgtcttctctcgctgttaacatactaagaagtggagtcattcagtacaaatatctaggaatgtgacaatgagggcttgagtttctgctatggatccttggttatctcattttcaggccttcagttttcttatctgtaaagaaaaataacattcctgacctcacagagtagttgtgatggtcaaatagatattttatgtgaaacaactgtgtcagctccaaaacactgtaaaatgcaatgctaaatgccttctgtcctgtggctcaggaattccggagagcttctaatttccactaattcagaagctgtgtccaaccgcaagccaagagatagcctccttttcctcccttcttctttcttaggctctttcttagaggtgtggccaaggatctccatagagatcaactgaaaagcattaagagttgaaattcaaccagattagcaagaaccagcaagacacacatccctaagtgttgtggcttgaatgtggcatcatgttacaatgggcatgctcttaacctgccttgcagaacaaagcacttgagctttgtggctatttattccttctctaacaagttcccaaagtctggctgctagctgggaggctgatgctatatcatggccatttaggttatggtccccaacaacagaccacactgttgcaagactctgtatttatacacatgctgttccaagctggaataactcagctagcagttatgagactttccctaaaaagataaacaccctccctcctctgagatctcatacaaaaaactccatctattgggctgaacttgtctgtttacaaacaagtcttagcctagaatagaccctaagttcctcatgtacagaggttttagctcatctttggaattgtaacaatccactgatattagctgaaataaatgcaacttattaaatcagtactttttaaaaaaatacatttctataggtttttggggagcaggtggtatttggttacacaagtaagttctttagtggtgacttgtgagattttggtgcacccatcacccaagcagtatacactgaacccagtgtgtagtcttttatcactcacccccttcccaccctttcccccggagtccccaaagtccattgtatcactcttaggactttgcatcctcatagcttagttcccacttacaagtgagaacatacaatgtttggttttccattcctgagttacttcacttacaataatggtctccaatcccatccaggttgctgcgaataccatcagttcattcctttttatgtctgagtggtactccattatgtgtgtacacacacacacacacacacacacacacacatacacaccacagtttctttatccactcattgattgatgggaatttgggctggttccacatttttgcaattgcgtgtgcaagtatcttttttcatataatgacttatttttctctgggtagatatccagtagtgggattgctggatcaaatggtagttctacttttagttctttaaggaacctccacactgttttactagtttacattcccaccagtggtgtagaagtgttcccttttcactgcatccatgtcaacatctattattttttgattttttgataatggccattcttgcgggagtaaggtggtaccacatcgtggttcgacaaagcaagcaaaaacataaagtgtggaaaggacaccctattcaacaaacggtgctgggataattggcaagccacatgtaggagaatgaaactggatcctcgtctctcatttatataaaaatcaactcaagatggatcaaggacttaaatctaagacctgaaactataaaaattctagaagataacattggaataaccctttgagacactggcttaggcaaagatttcatgaccaaatacccaaaaccaaacacaacaaaaacaaagataaataggtgggacttaattaaactgaagagcttttgcgcggcaaaaagaacagtcagcagagtaaacagacaacccacaaagtgggagaaaatcttcacaacctatacatctgacaaataactaatatccagaatctacaaggaactcaaacaaatcagcaagaagaaaaaacaagcaatcccatcaaaaagtaggctaaggacataaataaacaattctcaaaagaagatatacaactggccaacaaacgtatgaaaaacatgctcaacatcactagtgatcagggaaatgcaaataaatcagtactttttaaagaaagaaacagattcagcacctatgcagacagtgatttacatgaaaacaatctacaaatgctacatttgttcctttctgggcattttttacatattggctaataagtataactatttttatccaaccctctttaccatcagggaaaatgtctcccctcacctctttgaaaccatacacaaattacatttttaaaatatacaaaggattgcaggtcctggaggatgtagcttttttggggtgtagctccactagttgcatgctgagtaaatccaatgttggctgatacctgaactattggggctcccttgccttcttcctagacctgccatgtagtactgtcgttaatgatgtcctctcactccagctactgcccacttaccctacagctatttcaagcttgcctgaacagtgcatattttcacatttcattgaattctcaacaatgagggagcatgatgtgcttacctactaggtccaagaattgaaatctttttactgaagtcatcaggagctagaaactaaattcaagtaacagaaaatcttctgaatctgtttctttatttaaaatgatgtttaaactttgtataccctctcaattttttgaaggatagtaaatgaagtcttagctgagagtgtaaaagctaacttatatttttacttattctacctactagcttgaacaggtcatttctataagaaccgagttgtctgatcagaaaaaacaaaagtgttgaatggaaccacgtgtttctgaagggaggtgtcttagactgggtttcctagaagcagaggttgaaatggggtttctcggacatgaggtaatattggggcggagagaaaagctctcagtagaagagggaagagaggaagcaggagaaggcagagataagacctgtgtggggatgggctctcagccagagccctgcataagcctgatcccatgcgatgcttttgggcatgaattgcattacagagctgattccagcagggggctgacctcctatatcccctgagcagagagccaatcgccatggtctgcgcacatcaagggaggaggatgcatgaccttgcaagcaagatggtgcccatcggccaaaggttattcccttaaaaggaagcagctgtaagctattagcagctgatacaggagccgggggatggtggggtaagaggcaagaggtcaacaactgcatcgactggagaaggaattggtgtatatcacctcttttaaaatatttcagaaaactccccaaaatgacacattttcctaagatgatggtgcaaagagaactaaaatgtcataactattcattttatcaatcagctctggtcatgggggcaacctaatgctaatctaaagcttgaaagagttatggctatctttgattaatgtaaagaggaaaaactaggtcatacttaataaacgccatatgttgatagacaacctgctttcaaaatatggaggccagggtaagttaaatggaaaagttgaaaggtagctgacttcagaaccctaaggctctgtgagcttagatgatgcccagaaattatgttattctatactttacacaaggcactgcaaagagacattttcagttatttctattcctatttcataaataaaaatgccttttgataatatggatatgcttcattaattgctgtcccaaacctctcttccccccaaaatggtatgagagtcaggtttctggacagcaataccaagtaatccattggaacttctccatttctgacttaatacaagcagtaccccctaacactttcataagtctctctaccttaaccccaacattttatactcattcactgaaacatacctggtaggtgagaacatgaaaggtggtgaatttattttgaataaatatgataacctccaaatttatgattacatttttaaaagtgggaacacttgcaccaacaatattacctttttaatttaggtgtccaaatacacacatgtggataaataatattatatacagatatatatatatatacagatatatatatacagatatatatatacagatatacatatatacagatatatatatacagatatatatatacagatatatatatatacagatatatatatacagatatatatacagatatatatatatacagatatatatatacagatatatatatatacagatatatatatacagatatatatatatacagatatatatatacagatatatatatatacagatatatatatttgatatactgcataaagaaataaacaagttagtaagtgtattttctattgttttttaaatgttctattacagtcacaataaggtagagttttaaatcatgttcaaagagaaataccatattaaaaacacaaaaaattgcaatgaatagtataaggtttcttttgggtcaaattcagaacgtgttagaaacgcagccagagagccaataactcagaccaggaaacaccaagaccaaactgcatcgagtcgtggttctcccagcggctctctaaatgcctggccatcctgcaatataactgaaaactcagcacagagcaaagggacacatcgtaggctgggtatgagcaccacaaaatccattcctctgaaatctgtgagcctggggctgatttgtagctgctggggttttgatgcgctaattgtttgtttactttgccttggaggagaggctggccctctaagtggaatgatctcatcaccagcttcattctcctttttgccaaaacaaacagcttccaattactgctaggaagagcctctgatctctaatcagctaccaaagggagcctatcggtggtactttatagggcgaataacgtcccattaaggaagaatctcttaacatcagtacaattctggaaccctagggccaagctgccagcaacctgctattagtcttccagcaggatcccatccactttctccctgggcattctgaaatctggcaaagacacagacacacatacacacacatcccgcctcacttgcccacggactactacttttcctcaaaccctactgttttgagcctccattgagaaaacacaggcagacaaagagcaggtcccaggcctgccaatgctgagattgccaatggcaggtcccaagcctgcccatgcttagggaactgattatgtttagagcttaagactcagctacacctgtgccatcatgggcagacccagaggaggtcagaggagcaggagtgtccaagatgaagcatagggcatgaagtcactctcaaatgcatcaagagtcacctataaagagacagggcttatctcaggcaccacctccctcctttccttcttctttaatcttctagagaagttgagaacataagaggagagatgtttctccctaagtgagcatatgtcagcatcgtaccctttaacattacaggtgaccctatgaggaaccgccactccaaagtaggtttaaactttcccagatggctgaatctttgacatacaaacaaagcaaattaggtcagtttcacagacgtatgaacagtgcagtccactatatgctcacaagaggacctaggcttggggtatgctctgcaatggccatgctgaaattctttgagtttgagttttgtatgtaagagtcaatagcacactgcagtactcactggagagtggacatgtcagctcagaaccaatcctgactcccaccgcaccctcacctctccaggacaggttctcaccgcccattcccccatcacctggcacctcaggccccactggccttctgctccccacctcccatcacatgatccctgcccactatggtccctgcagggaccgggcatgggtgtagggaagatcagggttggccatatgcatgtcatacagtgtcccatggtatggttgtgtctgtccccattccatgctagtagcatgatggtgtgtttggtgggtggccagcacgattctgagacactggaatggcacatccactgaggaggatgcaataaacctgggagctgcccatctgctgggggcaggagcagctggcctatgaaggggaggcacctggctcaatttccagaggacctgtgccaggcaagagtacaatccccgggtgcagcagcaggcaaaagaggggacctggccagcatcatgcctgagcacatgtgtctgagcccaaggccctaggtgcctgtgagacatgagtgttccctgggcacaccccaaagccttgggggagccttctcttcctccttccaccattcccgagtctggcctgttggaccctctggccatttcagggctccctccaggaattaagtgctctgatatttacatgtaaagctggcattgcacaatataaagaagaagagttagcgtcatgctaaaattaaactttaaaattttcttcactgagaacaacatggataggaaatttaaaacaccatgacaagttaacagaagcaagtggcagaagaaaggaaaacgttttatatcttatttcctttaacaaacactttttttcttgctaagaggccccacgtttttattttgcaccagggcctgaaaattaggtagtcagtcctgaagtaaattatccagctaaccaacaaaatcttaaaaatagaaacaaaaccaaaagctagaagccatcctcactattaacccggctaaatcgtcaatgaactgtgtgatgagccaacttttcaagacctctgagttcttccctaatttagtagctgcctcctaggagtgttgtggggattaaaagagtagtacttgtaaaatacccagaagagtggctgctccttagtaatcttccgggtagtgctagctgctgtattaccatcacctgcatcaccccaacatgttttgcatcctgattgcatcttgcagggcaggtgcttctctcccccactgggcatatgaagggttaacattcaggaaggtgatgtgatgcacccaagctacccattcgcgacgctacagagcctgggtgtagagcaggtctgcacagccccaaagcccacttccctgttccatacctcacagacccacagctcctcttcactctgctaaccgcacatatgtattctacttgtgagcctgaaatagctccatgccaaatgacctggacaaagcatcctggagccagatactaatatttcaggaggtgctaacatgcactgtttcttttcgtgaatgaagggcagcattcagtagtgaaatgatggggtttccatcccatcttcctttcttcctttccaggtcagagcagtgttggattactcaggtatccctggtctgcattcccacccccatgcctcagtactgagtcccttgtgtttttgggcgtggttgacagccactttgtgcaggtggggcagaaacagcctgcagacctggaggtgtcaggtgtgcacatctacccactgcttttctgtcttgttgctgaagggctgggcagtggaggacagtggggacaactggggcacagactatgagacgacagcttcctctgcaggccgacgacagcaggtcactgccccagggaatctgtgtcactgcctacaccatgagtgcataggttgcgctctcctgaggcaaggcctgacagctttcataattgagagtccacatacctggcgggcatccaggctggaggccaggcaagcttctcccatccttaaacatggcctgaaaccgtgcaagagaagatggaaacaggcacctgctccagagacagctttatgggtgggctcatttgcaggagttgggggcgggggtgaccctgtaggaaagcaatcttcttaagacttcccgtagcccagtcatgagttgtctgcagactgattgctccaccttccttcctttttttttttttttttttttttttttgagacagtcttgctctgtcacccaggctggagtgcagtggtgtgatctcggctcactgcaaccgctgcctcccgggttcaaggattctcctccctcagcctcctgagtagctgggactacagcatgcaccactacaccaggctaatttttgtattttttgtagagacgggatttcaagttggccaggctggtctcaaactcctgacctcaaatgatctgcccgccttggcctcccaaagtgcagggattagaggcatgagccactgcgcccggcccatcttccttctaattattaaaaaaaaaaaaaaaaaaaaaaaaaaaggaaggcaagcggtggggaacagggaagcttggggttttataaggagaatgtgttgctggcttttcagatcttaaaaacacttaatccctgcaatttagataaatcagataggcattaccaggttagggttaaggctcccagaatggctttgcaattgattacaaacacagcacttattaagtcttaactgagtaatttgcagcttatttcacccccagctaattaaaatgtaatcaggattgtctagcaatgtgcattctgtcagcagtttttcttccaaagagaaatcatgccaaggagaccacaagaaaagcctttcacgggaactggcttcatctaagctggtgctttagccactgaaactgtaaaacaaataaattacagcactgacaattcaagaaaaagaaaaaaaaaaggtactctttctccctgggaataggctgctccgttttgttttgttttctgttgtttcaaacaatagtgtggcatcttaggagagtgactttcagggtaggactcggagggctggaaaccaggtgcctggggatcggccctctcctggctctgtccaggatgtctgggtaatttcaccacaggaggtgagcactgggtcttccattccctgaagacgcagaaggactacagagcgtgcccatttctctgacacccacgagacgctgcttctacgacttagaacaaactcaactgcacactcgcgaacgcgccagcttcaccagccggttcaagatcatccccgagggtaaggggaatcacttccacattccacccttattaatatggcctcctctggcagcttaattcccagggcctctagggggacccccccccccaccccttgacccagctctggcaggaggggcgcccagtttaagagccaagggtttggcttccagttcccgcccagccaggggaacccctccccccagcccccatttctccttttggtccctccagagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaagcgcgcgcgcacacacacatactccccaccctcaggctgaaagaacctacgttcggggtttgggggacggttcccccgggactcgttgaggagtatccgaatacggccccgccaaatcccctgtccccggcacttcttccctgacgctctacgctagtccagggcaagaccttgaatctttggggttccgaattgaggcgcgcacagccactcgcacccccaacacgcgcatacacgcaccctggaacacgacttggcacaagtaccctggctggggctccaagggtgggcagcgagctctgagccctcagagagtgaaaaccatctttcaaaagagacaaagtgtcggcccgcgggcacctgcggggctggggctcgaggtgaggtccccaggcgcagccggacgcgcctcccagactccctcccagtgccccggagcgcctgggactttgcgggagtcgccgcccgcccggagtctcgcgcactccaattcccgggaaaccgccacatccacacacccactcccagcatccacgactctccctccccagggaaatcgcctttggtttcctgctgggaaggagggagttggggcaagatgtctcgggcttctttttcttttcaggagccgggaagaggctggaaaggagagttccagcaccccgactgtaagatccacgcccaggggaagccaggatcagccggcggcgctggccgagaactttgcgagcccaggctgggaggcgcgcgccccggtgcgcccacgccgcggccgcagccccagaaagaacccgggcgggggcctccccgtacctggaagtgctggaagaaggcggagatgcgagtgatctgcaggctcaggcacctggaggcgcagcgagcgcgctggacgctcccggcagacagcgactcgtccagccgccgcgcagcagccgcgccggggccggccgccaggcagccgctggaggccgccagccagaggcagagggtcaggaccgcgccgggcaccccgggcaccatggctgcgggtcgagggcgagggcgagggcgccgggcgcgggccgaggctccctgctccgcgccggggctgcactgctgaggaccaggcagacgccgcgactgagccggaaagttcaatccttcaactccggccggaccctcctcgccgacctccctcccagctcgccctcgaggggtggggtgagggggacaggaggccgcaccattggctggaaggcgtgtgagtgacaggggggccgggcgcagggcccatgggccggtctcgtcagctgcgagcccgggcgctccgggggagggcgacgccgagcggctttccacgccgcgcaggtctcgaggggcccagctcccacgcaggcgcctctcccgttcgcaccaaccgcttcctgcccctcccaccttccccctccgtccaggtaaacgtcggtgtgagcaggtccaggcctgccaggaggggtgctcccttcagcaggagggaagaggcctcaggacccccaggggcgtcccacctgcctggggattgaccccgcgcccctaagtggcttgctttctccccgacctcccctgggtccaggcttttcccacgctttcacatattcgaatttcctttgcccaggtagtggaaagaagtgaagaaaacaaatggcagtaagacagacggggaggggagcgtggacatttgccctacagtgtcccggagacaaattcctccttctctccctcttgcatttcttccgtccttcccgcatccctccctccctccctcccgcactgttttccctggagacagtctcagtgcatagctaaccacctttaggtccacacgccttgtttcctcaggtgtctgtttttctagtaagccttgcacgccccaaagtgagtgatttattctaaatagacttgcgtcttaatctctttctttccccacgatttgcccgagcctcttgactcaggctttttagctttggaatggctgctccgtcctctcctgtcgtttttgtctagtgttctctcagcacacaaattctccctccccagccaggatcctgccacagaaagacaggaggcattgataagacacaacttgtaacaaagctctacactcccctgagccccatcaggaagtgacagtccccttgcaggtaggagagcccagagaaaaaagacccaggcacactcctattcgaatggacaacaactgactgctgttcctttgctctgacatctccaccctctcctacccaattgcactttcaccttcgaaaacgggatctctataagcacccagctaagcacagtcagggtatctagatgcactcgctctactcaaagctacatcagaaggctggaatcctctttgcacaaagcctatatagttgttttgcaatttcccacccttttccctattcttatacacaggttccactctgcaattttgagatctgcctgttaacaaattgcaatgacagccatctgcagctatcctattatgagtgcttttcaaatacatcatcttacatgtgtatttcttcacatagcttaaatcagaaaggccagtcaaattaattggccttggtgtgtttctcagcgaattagaaaatcagggtcatcttgttcaaaaggttctataggcaaagccagtttcatggacatgcaagctgtacaatggtacagtcgcactcttagaaggcctgttctgccatcaccatcctgaaactcttcacaatgacagtggcctgttaggaactgggccgcggcaggccagggaacattactgcctgagctgtgcctcaggtgagaaatcagtggcagcattagattctgataggagcttcagtcctatagtgaactatgcatgcgagatgtctaggtagcgcactccttatgagaatctaatgtcgatctgagatggagcagtttcatccccaagccatcacttgctacccccaggtccatggaaaaattgtcctccatgaaaccagtccctggtgccaaaaaggttggggccactctttacttgggctggaaacctagtaattttggcataagcttacacgacttcaatgatttgttttaaaattgctcagaattgcaaatggaaatattttttaagtatgttaaacataatattaacgaagagtaaagaagctaactataatgaccccaagcaggcatgtgtataaagccaagtgtcaataaataatgatgtctgaataccgagattgtcttctaaatgttgtcactttcatttgtgaattactaaaaacatttccaaaagctgtaggggatcctttcctagtgtttgtttggagttgttttgttttgttttgagacggagtctcactgtcacccagactggagtgcagtggtgcaatctcggctcactgcaacctccgcctcccgggttcacgccattctcctgcctcagcctcccgagttgctgggactacaggcgcccgccaccacgcccaactaattttttgtatttttagtggagacggggtttcaccgtgttagccaggatggtctcgatctcctgacctcgtgatctgcctgcctcagcctcccaaagtgctgggattacaggcgtgggccaccgtgcctggcctgtttggaattttaaagttaagcaaatatgtggtcttggtgaaggcaaagatattatgtacaccgacattttcttaggtaactttgatttataattttgcatgtcatatcatgaaatgcatattccagaaagtgaaatcacaaggacaagcatgctgagcttttaaaaacagcctttggatgttcacaggggttgccgtttttttttttttttaaaaagcagtgtgtgtgctacttatatgggttccatagcatattcatttctatgaataaatgcgttttgtaataaaccacaaaggagaacagtcagtttaacagaaaacttggttttaaacatatagagccaccttattataaatatgttaaaataatatttgcagttatattgctttcttcctttagaataatcacagacatcctctgtgattacgcaggcctttctcatattatttactttaattgcagcttaaagtaacttttaaaaggaaagcattctagtaaagtcagaataacagtcaaatttcggtgtttttttgttttgttttgttttcattctgcccatgtatgcccaacttattatgcagctcaccttgcaaactgaaacatggaagttctctgacttttgacattaccaggtaagccacaatctaagttcatgaaagccaaccacaggggaggagaaccctaagagtatgctgaggaaatgatggataaaggggtaggaccctcgggtgcagctagtaagacggtacttagtatgtctttctccaaatctccttgacccccatgatccgaatttgtctagagaagaatttaacttcacattgactttggtttgacttaaatagacaaacacacatttaacaaagagagtagaaaagcaccttaattatctcttatttatatctacatgaacaaagatagaccaaaatgtgtggttgtcttggtcaggttctggagaaatcacacaaaataaagccctctttcacagtttccaaaaattattattttccttgtattttaattattggtttttcttttctttctttttttttttcctgtttttctgcagagaatgagaaacacctgaaatctttactaaacatagactccagggccctaaattgagagattctgagtcagtatatccggggtggagggttgaaatgtcagcttttaaataataccccaagtgattctatacaaattcaaccagggactacactttgagggataattgattttaaaagtacatctgaagcccgactcggtggctcatgcctatgatcccagcactttgggaggccaaggcaggaggatcacttgagctcaggagtttgagaccagcccgggcaacacggtgaaaccccatctctacaaaaagtacaaaaattagccaggaatggtggtaggtggtaaacatctgtggtcccagctactcaggaaacctaggtgggaggactgcttgagcccaggaggtcgaggctgcagtgcacccagatcatgccgttgagttccagcctcagtgacagggccagaccctgtctcaaaacaaaaaacaaaacaaacaaataaaaaaaagtacataaccattaaaaatggtacaaaaaattttatttaaatagcatctatgatttactgttgtttaaagtatctttttttagatgtgtgtttatatggattggacatactagtctatttcttaacaatcaaatggacatatttttccagtacatttagctaagactctcttagactcattgtttttttcagaaagcaacttgcctttttaaagggctttcagctacactggataaggataaagtttgaaggtagcaaatataatctttatctgacatgcctctcttggaaaagcaaaatgagaactcactcaaaacttggagaacaaatacttaaatatgacagcatttaggagtcatgaacaaaacgacatcgtccctggttttggttctcaggggaaagtaaagtgaggggaagaaagtcacagatgaggtctagtttcctttctagttgcctccatttgatgatgcaagagtgtgcatcttcccttagaaactgcagttcacttcaggaaaagcaacagtggcaagatgaaggagtgtgccctgcaagctcactggccatgacccatacttccaccctctcaggcaatgttctcaggctttgctagctcagttccgctaaagctcttctttaaccgctttccttctcctccagacttaatttctcttctgcacagcacaggatacaattaataactgaatggataaatgtcagattttcatctttcgcaatatggtttcaggcaggaatgaggtgtacctttatggtactgtacccatctgttcccgatggccaatttaatgattttacaaataacaatgattgcttttggcatagggtctttgaatatacactctagtttacacaaaagaccaccgcatccatttacagtcttctgctttcttttatcaccttgcaaggctagataccctatttggggataactttagcatataacacatttttcaccttcaacgagattataaaaatttagttgcagtccatacagtttaaagcgatcacttttattagtcatcttgatgtttcctaagattttacaaagtttcagaattgtgtttcctattacttttgtgcactaaagactattttaatgacatttaaacttcctttgcaaaatatacgaaaaattgtcaaatactatgatttctaactaccaccacttctcaataatttgtctctttgccctttcatattgtcatgtcatcatcaatcagtgttaaatttgtttgctgcctgtttacacttgtgctgagagtctggactaagaaattgctaaggtatttttcctggctgcaatcgttactaaagttaaaataattagtaaaaaataggccgggtgcggtggctcatgcctgtaatcccagcacttcgggaggccgaggcgggcggatcacgaggtcaggagatcgagacgatcctgggcaacgtggtgaaaccccgtctctactaaaaaaaaaagaaaaattagccagcctcgggaggctgaggcaggggaatcacttgaacctgggaggcgaagactgcagtgagccgagatcgcgccactgcactccagcctggtgacagatcgagactccgtctcaaaataaaataaaataaaaataaataaataaagtatgtcagaggacgtattttcatgtgtcaagagcaattgtctggcgatgggaatggtgatgtgcaatggtgatgttcggctgtgggtgcactttccctcccggagccccaccatgaatcggtctctctagcacatgtgatggcctctgttgattctggtgtcttacacagcagaacagatgctgcacccagcaaggagggtgggtttttgaaacccagtggtttcacaggctgcttgacgcccgtaaaatgaacgcttgccccagtgacaaggcagttagctaattttaccctacttctaacattaccaacactattataagcaaccataaatacttagggctctcatgtcaaattctccgtacaagccgtagatattgaaaaacatacaaatagttagaaatacttaaagtcaaatgtgggaggctattaaaaatataaacaataactattgtatttcaaaaatgtatgacaaaaatgttactggcttgcccctaaaatatttggagaagcataaacaaattaatagaagcatgaatttagtgaagtcttaaatgatataactttaattaaaaatgacatttctcactttcgagtggcctatttttcatgtgaagagcataatgttcttttcagtaaaatttgtacttaaaattttgtaaaatgagacttttttgaagcagtttttttaaacaaagctcaaataaatgatcatgtttattctgaatttcatgtttaaacatgaaaataaatctacaagtgctcttcagaattactgaaactctattctgttgaaagtattaagtgggtttttgttctctgatgttttcaagccttttgaaattgacattgagccacataaataccaagcgatttggagagaagccgctggaaattacaaaagcagctttttaacaggagacagcgccacacgctggccatttaaataaaacgggaaggaaagcacagaaccgtctctgtgagataacctaattttaggacaaagctgtccactctacagcatatatctgactggggtaatcatgccacattttcacttagcactaacttaattacttccagtgtggatttcaatattgcaaggcgttcctgcatctctacagtcacactgacctaaattagggagattagtatagcagtttcaaacaattttttcctaacttttaaacactttccaaatattccctacaaaattaactgacaaaggtggactgtgaattacatctatggaagcatctgtttggaaccactttttttgcagctcctacatggcttgctttttaagattttgtaaaatgtgagaacatatgaataaaatttgacgccagggaaaagaagggcaaaaaaagttgacaggctttatctgctgccttagagaacatgaagaagacccagaaactacctttcaacactcgccagccgctctgcacaagatgagacaacagccaagagatgaacataaacatgtttggaaacctgggggaagccctgcattgctccaagaccaagcgggcagggcctctgaatgtaactaaggcatgaactaactgtttcctcttctgtatccactggagctaataaaaagcatcccctaggaccacaaataaaacaaaacaaagagacatattttatttccaggattttctgtagtggctagcatgaaccaactggagaatattccgctctgagattgaattttgggtgtttcagagtcagagagcaaagctgactcccttctggtctcttctcctcattgtttctgggactctgaatgcccagccctcctcaggcactatgtagcacatcaaaggtcgactttgagttccatggagtgccaaggccaggagttcacttcgccttttgttttcttagcaatctgtgtttcactgggacacagatggacaacagttgaatatcaaacatggtaaatggagcctgggcaacataacaagaccttgtctctgccaaataaataaataaataaataaaataaaataatcagggcaagtggcacacacccctagtcccagagaggctgaagtaagatcgcctgagcctgggaggttgaggctgcagtgagctgtgattgcaccactgcactccatgctgggtaacaaagtgagaccctgttttctaaaataataagaaaacagaaaagaaaaaaagatggtgaatgggattcacttgatgtttaaatggcgattcctaatgggaatgtttcttcctggtctttctggacattgcctgagatagctaaggtagttagcaacatggtaacaacttctgtgctcaaaaagaaactgaaggggaggtgtccatatgtattcaacacttttctttttcctctcctgcaaataattagtagctaccattctgaattgatgagagttcaggtggtatttatccctgaggaatttatttccagcatctcaatgttcataatgcttttcatatatggaggaggacggtgctaggaaaagcattcagttgagagcattcatacaggcagaaatgctcctgaattactgatacagaggaagccagtgaagaccagtggcgtgattggagaaatggtcagctcatttatattagtaggatgtcgcccagtgaattactgcttcctggcattatgcacaaagaaagaaatgaaaagagatctaaacccttttctgttttcagaagattaggtgcacatgttcattgtttatttaaaatcaaaagactttttatcattgtctgcaaaaactttaaagttatgactatcataactgcctactcagacattaagggattataagacatcatagatagatagatagatagatagatagatagatagatagatagatagataatttagatagatacaattttgtatgtatatatacacaaaatttccataagtacaaggactatttgtagactctatttttctttgtcagtttgtacattttaattctaattatataatttaaattttacaagccttattatttttgttttatacactcaatattcattatgatttaatatttatttatcctttacattgcttcttctttcttatatttccatgtttccatctgggatcattccttctgctggaagaagttaaatatatgcaactgtatatatatattagtatggttctattggaaacagattttctcagatttccttttttttttttttttttttgagatggagtttcgctctttttgcccaggctggagtgcaatggtgcgatctcggctcaccgcaacctccgcctcctgggttcaagtgattcttctgcctcagcctcccaagtagctgggattacaggcatgcgccaccacgtccggctaattttgtgttttttagtagagaaagggtttctccatgttggccaggctggtcttgaactcccgacttcaggtgatttgcccgcctcggcctcccaaagtgctgggattacaggcgtgagccaccatgcccggcctcagatttctttttgaggggatgcattgccatgtctttgtttcatttttatttttggagaatactctttctacaacagaattctagattagcagttatatcctgtcctcattatcgttgttcattttttcaaagtagaacacgggtcttttctgtcattttggaccagaagatttcccactcagtggtcttcaagccactcagcagacaagggaattacttcttgctgaggatacaaaaatctccccatctgctttgctcttaccttgttgagcttatggaactgacttattcccaagaccccttcctttgaaactcctgttcctaaacagcacatatccctagatttcccatgtctcttcctcagtttttttccctggagcctctttttacatccttctggattcgtcactgttcttgaaataatctgttccatgtgatagaatcgaagggcaagttggacaaggaggctttgcatgggaaagaagtccatgtggcaggaattgaggacactgttgctctaccttacagagcccagtcagtactggggctctgtcttctctctatgctgtgaaaaccagaatctcgtttgccagtcctgacttggtgtccacttgggtgaggggctctggcccaggtgtgggtcatttatttttgaccggggcccaccacagaccctgagtttccttcccagagatgaagactctgctttgggtcaagcagctatgcaaagaggcggtgtctacgagtggctccttgggggcctttccctagttgctctgcagagctgtaagatttgcatgtgtctctctcaaccacctctgccctgagctttcactacgctacgtaagaccaactccctgttgggcgtttccaagggcgagacacacgcacaatcctgcctcaggaacccagcccccattgcccagtgcaggaagcgtgcctggcctattgcaaaagtacccaagacggtcaattaaataaaagctgctgaaagcatagagcctgcaaaagactgcctgggtatgaaccccagtcgaccctgtggaagcttttagaagtgtggacttggggatattatatatgttctctgtagctcagtgttctcaaatggaaaatgggaaaaacataccaactttgtggtgtcataagtattcactgagttaatatcggtgaacaccaccggaagtgttagctcttatcacgtctttctaaaattaggatatgctattattgttgccctctttaaaaatcatggctggatcccccctgctgatgtgacagttgtttatcatgcagtaagagttgctttataatgtcttccctcctcaaagttcatctttccccagacccatcagtgtcagccacgctacggaagaactaaacagctggcgccttcacgctgtcactccatgcccatgccagtggtggatgttgctctctcccctgaaatggtcgtctctcctcttggcctgccaaccctggtgcactgagaaatgtattattgtccccaccttaggtaactgtattgtcctatgggcagccttttctaacattctcagatgacacctcctgagtattttcttcatgctgttcatttttattatgttcgccacgccttatcaagtctttgtttacatgtccatgtccatctccacttcttatggctgatggctatttctgataggcgctcaacaaattatttgcctggaactggaaatactcgacactcctcaatttgcggcctctttttttcttacaacttcttaattgttgtattcaatatgtaatttttactctaggtgttcagaagtatgatataagaatttacgaatagcataaacgttatctgaaattatggaggcctaaacccaaaattcatcagaccacattctctctgcttcccagaatgtattagtagtttggctgatttaatgctggctgtcctggttacacttgccagcagggggcaccaaagggctaccctgggagaaagccccagaacttgcttccaaagtcagagttgacactggagcctgaagttccctcatagacaagacaccttcgaagacaaagcttaagatggcaataatgaattatcctccagcaaagcctgaagaggaccagcgaagcaaggaaggaaatcctcaaaccattacctgagagacaaatcaggtgtcagatcaaagatgaatttagtattagagagatacttcttaagtaaagcacaaaatgcattaactaaaaaaagatagagaggccgggcgcagtggctcacatctgtaatctcagcactttgggaggccgaggcgggaggattgcctgaggtcaggagttcgagaccagtctggcgaacatggtgaaaccccgtctctactaaaaatacaaaaaaaaaaaaaaaaaaaaaaaaaaaaaaaaaattagccgggcatggtggcgtgtgcctgtaatcccagctatccaggaagctgaggcaggggaattgcttgaaccagggaggtggaggttgtagtgagccgagatcatgccactgcactccagcctggtgacagagcaagactccatcaaaaaaacaaaacaaaacaaaacaaacaaacaaacaaaaaacagagagagagaaaatttcaatccacttggtcatgttaaaattaaggcatattgtttaccaaagacatcttaaagaaagaaaagagactaattacaatgtggtagaaaatgccttcacaatacacaccagacaaagtgttggaataaagaatatggaattaattcctacacatgaaaagaaaagagcacaaacagaacaaaaaaaaaaaagagaaaatcttataaacaggcatggacagaggaagaaacgtgtttctaaaagacatgtttagcatcattggtgattggaaaaaatataaaataagcccacactctctgttattttttactttggcaacaatttaataaaagtctgaccatgctaattcagctgcaatttagaagtctgaccatgctaacttctttgaaagtgtatggctctacagcatcttttatttttaagatattagagatggggtattactattgcccgtgctggtctcaaactcctggattcaagcgatcttcctgtctcagccttctgagtagctgggactacaggcatgaaccgctgcacctggcttcaaagcatctttgatactttgctggtgcgagtatcgattaatgcaatgactctggaaaagagtcggacatcaccaccaaaaaaccaaccacccgcatagatgacgatccctcattttcactcctggtgcaacccaactgaagctaccgcatatatattatcaaagtcttgaccaagcaactttacagcagcacagctcacgttatcaaaatcctgaaaccaataaagtgtccatcgataggacaacagctgcataaactcttgcacattcacatactgaaatattgtacagctgttaaaattaactacagaaatgcatatgttaaacaaaaaccttaacagtatgtgaaaaaaatgccaacagactacacatggtaagatatactatctctttataaagttaaaggtaactagaataaaaaaaatacttattagtagcaaatatatgcaatagggcaggcgccatggctcatgcctgtaatcccagcactttgggaggccaaggtgggtggatcacttgaggtcaggagttcgagaccagcctggccaacatggcaaaaccctgtctacaaaaatagaaaaattagccgggcatggtggcatgcactgtagtaccaactactcaggaggctgaggcaggagaatagcttaaacccaggaggcaaaggttgcagtgagcagagatcgtgccactgcaccccaggctgggtgacagagggagactctgtctcaaaaaaaaaaaaaaaacacaagtatatgcaataaatttatataaaaggggaagaagcgatcatcgtagacatagattataagataatagtgggtaaaacaggaggatttgttgattgtataaggcctagcttttgttagtggcagtgggattttctggtgtccattacgctattaacaatacctaattaaatagttagctaaataagtaaaatgggctatacctggaacaatgttgcaaatgtcacggaccaggagttacaatttatctaactcagtgtacctgaaaattaaaaatataatgaagtcaaaataacagtgccagacactgcatggtcacttaagcagcaacacagggtcctaagcttctgttgcaatattaaatgcatcatttgttaaaagaatgggtcagaaagcaatggtttgtttgtttgtttgttttgtattctttctggatggaaagtcagagaagaataaggcttagtaattgagtgtttttcttaggaataataaggaaccaaaagatagtgttcagatgactgaaaagtgttagccttggggataaaatagccctagacttttgtagagctgtctcaagtacctagtgaaacaatatgtcactgtcagaaaaaatgagaaggtaaagagtccaagacagggaactgacacatgaggagaagatgagaactccgtggtttaaacaacccatgcttgcaatgacactggtcttctttttttattattatttttatttttccataagttattggggtacaggttgtatttggttacatgagtaagttcttcagtggtgattagtgggattttggtgcacccatcacctgagcagtgtacactgcaccatatttgtagtttttttgtctctcgtccccctcccgctcttctccccaagtctccaatctttggcatgggtgcgatgaacagggaacacttctacactgctggtgggaatgtaaactaatacagtcgctatggaaaacagtgtggagattccttaaaaaactaaaagtagaactaccatttgatccagcaatcctgctactggatatctacccagaggaaaagaagtcattattcgaaaaagatgtttgcacacacatgtttatagcagcaccattcacaattgcaaaattgtggaaccaacccaaatcaatcaacaagtagataaagaaactgtgatatatatatgatggaatactatgcagccataaaaagcaatgaattaacagcatttgcagtgccctggatgagattggagactattattctaagtgaagtaactcaggaatggaaaaccaaacattgtgtgttctcactgatatgtgggagctaagctatgaggacgcaaaggcataagaatgaggctggccttctgtggagctcactgtgcctgtctgcagggagggaatgcctttctttatagtttttcactctcctgggagacacggatttcaggatcagcattatatgcataatgttcaaaataaaatgggccaaatgagatcacataggagtaagtgtgggtataaaacagctataaggagatttcagaggattttaaaaggcaccacaagctagaaaaatagttactacaataatatgtctttccttatatctacaggttggtgagctctggaatgtgcagacgggtaatttgggcaaattttaagtaatgcaatattgggaagtaatatgtgggaaatctctctgtgtcagtcatttgaggttttctgctacttttattgaattgtattcttttatctctgttaagactcatttactttccaattacttgggtgagtttcaggagagactcctgttaaatgtgctttttaaatgctattgggagactattcagtaatatgataagtcaacttctgtttatttctaacttcgtaactaattccgggaaagttctgagcacatggtggggagagacggagagagacggagagagacagagagagagagaaagagagaaagagacgggggtggagagagagagagagataatacttgcaccactgtaattaaagtgaagggaagtgaataagaatccaagtaaaaaagcagactgtttaagttcaaaccacagctaattattcttcttttttttttattatactttaagttttagggtacatgtgcacattgtgcaggttagttacatatgtatacatgtgccatgctggtgagctgcacccactaactcgtcatctagcattaggtatatctcccaatgctatccctcccccctccccccaccgctaattattctaaaagcgattttaaaattctcaatccacaggcatttttatgtgctgagttttattgttgttgttgttgttgttctttgtttgtttgttttttgagatgcagtctcgctctgtcatccaggctggagcgcagtggcgtgatctcagctcactgcagcctccgcctcctgggttcaagcgattctcctgcctcagcctcctgagcagctgagattacaggcaggtgctaccacatctggctgatttttgtattttttggtagagatgggatttttccatgttggctaggctggtcttgaactcccagcctcaagtgattcgcctgcctcagcctcctaaagtgctgagattacaagcaccttgctcggcaagtgctggtttctaattacagataaattataatggctttgatttagacttgcaatctcacacactaacagcatgaaatactacataaggtgaactattattattattattattattagcttgcctctctgatgagtcactgaaatattcactataaagaaatggacttagaacttgaaggttgccacaaagttgtcaaaacaaagaaggaaatacttttattatattccaaaactttcttttctgttttttaatgtggatttttctttaagtgaaagaaaatcttcttttataaaatataaacaagtacataggaacttatggagtaatgacagctgttaaattctggtttaagttggagaattgtgtcattttatttgtggatacttttagtgtggataagataaatcaactgtgggtggttttgagttcctgcattattttatttatttatttattttgagacgaagtcttgctctgttgcccaggctggagtgcagtggtgcgatctcggctcactgcaagctccgtctcccgggttcacgccattctcctgcctcagcctcccgagtagctgggactataggtgcccgccacactaattagcccgccgggctaattttttgtatttttagtagagacggggtttcactgtgttagccaggatggtctcgatctcctgacctcgtgatctgcccacctcggcctcccaaagtgctaggatttcaggcgcgagccaccgcgcccggcctacattatatcatttaaatgggtgctgctcaatgctaaaaactattaggaattttaaaatgcagaggcctaggccctactgcgagacatccacatttaattggtctggggtggctttggtgtcagtattgtttaaagcaccttggtgatttgaatgcctccaggttagagaatcaacaagaagaatacttttccctaaattcaaatagtagatttcagaaaagtcctggtaattggattaaaataatgggaaactcatggtttctcaacatcaaccccattgacgttttagacaggatccctcttcgtcttggagactgtcttctgtgtgggatttttagcaacaaccctggcctttcaccactagatggtagtagaacctcttaccacttacaacaccaactgtgtctccgacattgccaaagggaccccggtggggcaaaatcgccccgctccccaattgagaagcactgacataaccaatcccatgtttttcaaatcatccattagttctaggaaaaccaaccaaataaataaacacatccttcaactaaaacagcattatataacaacacacacacagagacacacacacagacacgaacacgtaacacacacgtatgcacacagatacacacacacaacacaggacacaatattttaaaaaagatgttaaacaacccacagcacagaatgtttcattcaaaacattttgggtgatgtttcgaaggaaaaattaaccaatgtggatgttttccatttcttctactgttccactactccatgccccacccaaaccctgccttcttgcagttcctattcaaatagtctcaatggaacttcttatagagatgaaaacctttctatcttcctttctctaactagagaaaggctggaaatagcacctgcaagagctccctccca

SEQ ID NO: 260 - DNA, 383429 bp, Homo sapiens
agggacaatacacaggttatgttagactcctatcaaatcaagtaattaccttctctctggctattaggtccttttcccattttttctttctttctttttgttcagttaatctttcagagagacttcaaggccctaactgtcttcctagaaaaccccaaaactaacgaggagtaagcttttcaatcaacactttcatataaaagcccaggtcaaggatcacattacctagagctttgctgacagactggcaaactttactctaggaagtgtagcaagattcatttcccctggttctgggtcaataggtataaaacaatatgattcgcttctctcttcgttcctatagtatttctcctaagacctgatcctcatgcttccaaacaggaaacaggaggactgttgggattagcctgtcacctggtcacttaaccccactctcagcagcctctagttgtgacagacggaccaacaaggaactccccacaagctccctttccagggcttctaccccaaactgttgtcatgaaagaaaaacaagtccaactgcacttgtttatcacaacgctcctacctcatttggaaagaaaaataaacaagaattagtgaatttttatagactgattctgcaggagaaaaattaaatagatgaattattatcactttgttttggagtcttccatgatccttcagataacaaattccatgaaagaaaggaaaactttctcatcaagtcataattttatatttttttaaataaaattttccaaaaaaagtaacatggtataaaagtgtaaaagcttaaagaaatatatctgggctttgagactccactgaatatatcaacatatactttctattttgcaaaatagatattagaatttagatatctaggggtgccaagactacagatgtttccttcgagaccttttaaaaacagaagtctaattttattaaaatctaatgaaaatcataatggcaatttaaaagttccagatgttagagtcatcaacattgttcatcttttcttttctttttttttatggagacggagtctcgctctgtcgcccaggctggagtgcagtggcgcgatctcggctcactgcaagctccgcctcccgggttcacgccattctcctgcctcagcctcccgagtagctgggactacaggcgcccaccaccacgcccggctaattttttgtatttttagtagaggcagagtttcaccgtgttagccaggatggtctcaatctcctgaccttgtgatccgcccgcctcggcctcccaaagttctgggattacaggggtgagcggccgcgcccggcctgttcatcttttctttcacctttatcactgtgagtgaccttgtgatgcacagtgtggtcaaggggtgagtttaaacaagtattcatcccattagtgtacaatataatactcagagtcataaatcaagtgctacacacggtcacatcatcaaaattcatcctttttttggcacatttaatttttaaatcacttacacaaaaatttaaaaaattcaaaattgttattatttttgtttctccgatgtgtgactgacaagctttttccctcagtcactctctctacccgccacctctctctttctctctacacacacacacacacacacacacacacacacacatatgtacacacacgtatatatgtactatatatatatagtgtcaaatgaacaaatgaaagaaaatggctcctctaactccatccagctcagtgcttctaaataaggatgttgctttttgactttcgccctaccctcctctgggacgctgggtgccagttggatagcatatccatagctctcacttgagaaagcaggaaaacttaaaaatatttgccatttttcaacattctcccctttcctctccctctgcacatccggggtagatacaccaagtactcatggtactgctattagtactttctaaatgctgcctacacagaaagttgtctccattttgcctgcttgtgtgctcccagagcttagcttagacccaagcttccctatcagagcactagcaaagatctacagtgaggtggcttcaggctgctagcctaccctatttcctgcaacatcttcctcagcccggacttggtactctgtcatattgtctgcgggacacatgccccaacaaaatcacaattttttttttcatttagatactgttattctaaaaagtggcattatgctatggaaaccaaaagtaacaacaatgtattgaaatcagatgacattacagatgtaatgagggacatttgtcccatgtgaaccttcatggccatgtaattacagaagaccagcatgactggcgtgtccgtgtggccacagacagctgcaggaggagtgccatatgggctccaatgcttgccccacatgcgtatcttttacaaaacaagcatttgttatttgatttttctcagatgtgcctttccctgactatctaatatgccaaagaaccaatgcagaagttacttcttttgactacaaatatggctgtagatttactgagagtttgtctaaaaagtgtagaattacaccaaaacaacgttgatctaacccaaggttctcttggagacaaagtaggagaagctgcatatctgcttccttcccacaggagccacagatctgcagagcagcttcaagaattctttgttttgttttgttttgttttgagatggagtctcgctcttttttttagtagagacggggtttcaccgtgttagccaggatggtctcgatctgctgacctcgtgatccacccgcctcggcctcccaaagtgctgggattacaggcatgagccaccgcaccggcctacgaatccttcttagaatgttcatcccatcttctccgacctcttgccttgatcatcttgtggatttccaatactctgtagccaattctctgacctactttcctaacttcttcacactttgccttagcactagttcagaactagtccagggacactgtggattcttcttacgcaggcagagatcagtggaaaaaaatgagagtatgaaatgaaacatcgttggccaagcgcggtggctcacgcctgtattcccagcacttcgggaggccgaggcgggcggatcacaaggtcagaagatcgagagcattctggctaacacggtgaaaccccgtctctactaaaaatacaaaaaattagctgggcgtggggtgggaggcggagcttgcggtgagccaagatcgtgccactgccctccagcctgggcgacagagtgagactccgtcgcaaaaaaaaaaaaaaaaaaaaaagaaatgagacatccttgaggggcatttctctctgtagaagggagtttaagtttccatgtgaccacctggaacaggtggtttctgtcctccaagagaccacgtcccatctgaactcagaatcccgggaatgtcagacaaaatttcttccttctgacgaaacttgagtaagagagggagtgttctctgtatccagagcccaccaaggacacacccctggttaacaagttggttttataccagttgctatgagggggaacacacaacatgggcaggtgtcagaatggcttgactgtgggactcggactgtttgatgatttggggagatggtgaagagttggggatttcctctagatctgatgttgtcaggaaatggagatccatgattagatatcttagtaaattttaactgagagagaaaaccatccaaaggttgaatctttaattggtaaaaagcagtagtcactcctagtggccaggctagggggatgttgggtcactcttgtggcttggacaatgctagtgtctacctggattcagacatgattacaaagtggtcttgcttttgacttatctgccgtgatcatagtagcctggcctgaagttgaagtggtttatgttcaactgagggacaccattgcccagctgtgcgtgccaggccagctcctggatgccagctgctgcttttctcttcctcagtccccttgatttggccaaaagcaaacaagttaggccacagggtcttaatcagtcccctcggattttcaccatgcctgatatttttctgtgcaggaagttgtttagagaacacagtctgtggttggacttggattaatttctcctgcttcaggagatttgtgggatcattggacatgacagtagctgcctagtagcactttagagtctgtacaggacacttcaactgattgcaacaaaagcagttatcagggaaaacaaaaaacaaacaactcttagtccttgaaacaagttttgaagccaggggtggagattataaaacccagtgaatccagctgaatctgttttagagaaccaggtgactttcttttttcttagtttcatcatgagcttatttgtcctgcagtatgtagatgtaatgaaaagtgttccctataacatggatttcctcttggctagttaaggggaaaacaagctctatgtgattatctgtaagaagagtggtttgttggatttttaggcttttgttagagtcaaggagagattttggactaactttccatttcagtatttctaacgcgacaattgctgttgaccacagcatgcatatagatttatcacaattgtcacttcaggaaattttataaatagacttgtatagacctcactttaaaagtttctgggtaatttttcaacggaaatattatcaacgggaggtgtgataactttaaatatttgcagacctctaacaattatcctgagcccacggaatgcttctgtgtgatgggcaggtgtcagtctgttgtcaatataggaaagaatgatctggcgatacacggactgcattaggaatgaaagtattgtttactgcaataggaaggagcctgttttgtgtccctttatgaaaacaaaatttttttttttgagacaaagtctcactctgtcacgcaggctggagtgcagtggcaccatcttggcttactgcaacctcccactcccgggttccagcaattctcctgcctcagcctcctgagcagcggggactaccggcacccatcaccatgcccggctaatttttgtatttttttagcagaaacggggttccaccatcttggtcaggctggtgtcaaactcctgacctcgtgatccacccaccttggcctcccaaagtgctgggattacaggcgttaagacaccatgcctggctgaagacaaattttttgagtcaattttaaataaagtgtctggaagaaaacaaattcagcaaagtggtcagggtagccccaatgttagtgttctcaggattgaccagtccttgttgataggactgtaatgacctcagcagaatcattttgataacacgaattaaggttcatatcttagaagactgaaggttggtagtagtaatgtgaaggaaatttaggtattagatggcaatataaaaagggaatctattctgtgaagaatttgaaagaacacctttgggggtgtggtctcagacccagcaaacagtatttaagaacccatttttccctataggcttagaaaaatgttcagagctttggatttcctcacgtcaaagaagaaaaccatagaaataaaatataaatatacatttatatattattatataaatgtatattatataaatatatattaatatattatataaatgtatattatataaatatatattatattattatataaatatatattacataaatatatatctatatattatataatatatatttatatattatattatatatttatatatttatatattatataatatatatttatatatttatatatttatatattaaataagatatatttatatattatataatatatatatttatatatattatataatatatatttatatatttatatattatataatatatatttatatattatatattatataactatatttatatattatataatatataaatatagttatataatatataaatatataattaatttataaatatattaatatttatataatcatatttatataatgtatatttacattgtatatatttatattttattatattataaatatttatatatttatttatatttttaaaaatttatatgtatatatgtgtgataaaaaagaatgattattattagtgctctaaaggtggccagattagtggtagagtgaagagatagaaaagtgtgtgaatcagaaattaatcttattttacatctcgggtggaaaatatctgcttctgtagtcagtggcttctgaaagcctccaaggaatccttggtcaggaagcagtgaagtatgtcttttatgtgaatctgaagatcaaaaccttgaattttcctgatacgtcagtcattcacagtacctggtgagatctttttcattgaggctcaaggacagcttttctctgacaccttcacagtcttgccagggtcgcaccgttggcgggcagtgtgtgccttggaaacattgtctgcaatgcatcttgcagtgagcccaccaatgtcaggccatcagtctctgctcttgtgaaaaatattgtgaaacatctttgctaaaattcgattttcagaatagccaacttcttagataatcttaatgcatatcaaggctttttaattgtccatttattttagagaggtttttggagatgtcaggccatttcttggtttctgaagcaggttgaagatattgacacatctaaaatcatgtacctactggccaggtgcggtggctcacacctgtaatcccagcactttgggaggctgaggtgggcagatcacaaggtcaggagatcgagaccatcctggctaacacagtgaaacccatctctactaaaaatacaaaacaaaattagctgggcgtggtggtgggcgcctatagtcccagctactcgggaggctgaggcaggagaatggcgtgaacctaggaggcagagcttgcagtgagcggagatcaggccactgcactccagcctgggcaacagggagagactccatctcaaaaaaataaataaataaataaaataaaataaaatcatgtatctactatcaataaaagtgtgtgtgtgtgtgtgtgtgtgtgtttcaggaggtctggaaagtggtaaggacatttttgtgtgttgatagattatttaacgattctccttcagtcagttgttttctgtattcagttacttaattctcatccatatattctggtcttacctacgaaatctgagaaaaggacaggttctggaaagatttcttaagatatagacatattcagtaaagaaacagacttgggatgaccaggctgaattgttaataagacatggaatggctagcttaagagcaaatatacagaagttaatacagaggggggataataggattggctttattactagggtaatataccagggatatgagttgatgtctcagtttatgtagtttacttgttttttattgttttctttaaatctcttggtggatttcctagtttccctaagtataacacttcagcatatcttaagagacctgtagacgtccttctttgaatgatataaccacaagaagcagctatggatctcaagaagcgatctgcgatggtccagaactgcaagagtgggcccattcctggggatcgcgacggaaaggaaggtttctatgaagagccgggcttgctttgcagagctgacgttttgttattgaagaaaccttttcaaactggaatttggagaggcattttcacttcttatagatcttgaaggcattttcgtttcttgtagaatgctcagacactagatttctcataagcatcatttaaaacatgttacatttcagaaaaagttgaccagaagcgttcagtttttgcctgcctgtttttaatacctcatgatgtgctattgggatttatggtttcacttgtcatattggcacctgcgatggagaagatcattaaaaacttttttcaagttttcatttattgtacccatagaaaaattatatttctattaattgtagttggaaaattttgaaaagtgtgttgtaagccattccagataatatctttcttgttgtatagctattactcagacctatctaaagaaacggttgagtgtgaattacctcaaaaacaaagtagtcactttaaaatttgaaatgcattatgcacctgaggtgctgacagcaaagcccgtgccaggcatttgatccactgatacccattttccaagtactccagatccttagatctgcgtctcttccatttttgctgtggccaactttcaaataagggatcgggaaacagtttagtgatcataaatcacattgatggttggaaaaataaaaagtgttcctttgcttcttcagatgtgtttccatacatttttacacatcttttggctaaatcaaaaatccagatgcaaaatgattggtgcttacaaatgcagtgtctatttgtgacaacccatggaagaacagagggccgggaaaccaaacaaggctcttctctggcataacaaagggtaggtcaacactgccgaaagcaacgggcgacagattgcttaaaagtggatgtgggccaggcgcagtggctcatgcctgtaatcccagcacttttgggaggccaaggcagccagatcacgagatcaggagtttgagaccagtctggcaaacatagtgaaaccccgtctctactaaaaatacaaaaaattagccgggtctggcagtgtgcacctgtaatcccagctactcgggaggctgaggcgggagaatcacgtgaacccaggaggcggaggttgcagtgagccaagatcacaacactgcactccagcccaggtgacagtgcgagactccatccaaaaaaaaaaaaaaaagcggatgtggttgccattgctgtgtctgcattccaccaaatgatttattcagccaaaataccgcattcgctgcagtggataatattaaggaaatattttgacctactattaaacggtacatagtaacagcttcactttgacttttaaaaagtccagtctttctgataggacaattgactattctttccttatttcaccttttctttatttcccaatgtatttttaaataataaaagcatgttacttttctaatcataaaaatatatttaaaagtccctatcctgtcttggagacgctatttaaatcctactgttgtccctggttcatcccctcatgacaacaccttctccagctcccctctagcacatatttctggtggtggggactcctcatttgatgttcatgtgttaagtatcaatttgaacataagtcatttttttcccgatgtaattgcaggagctttggctgtcaggataatttatgcaggctttggtatgtcttggagtagtaatacaacattagcacaaagtagatatttggtgcacactaagctttctcttctgacgtttcttctccctgctttccgtagccctctttctatgcctttttaaggggagggggggacaaaagaaaatgtaccaaatttcaaacccttaaactctggcttagaacatttctgtcaggcttactatctttatattcctaccacccactctgaacttcgtcttgcattgagtaaacaccttccctccttcttgtagaataaagtctctatttattaccgccaatctccagatctctgtccccacctcaatcttaatctggagagaaagatagtacttttattaactttatgttggataataatataatggtggttattttaacagctgaaatgttctagtttcttagggtcttacctttattttactaagcatatttcctttatttatacttataattaattgtgctcattttgttattttattttacttttatttttgcttgttgtgatggttaatactgagtgtcaacttgattggattgaaggatacaaagaattgatcttgggtgtgtctgtaagggtgttgccaaaggaaattaacatttgagtcagtgggctggggaaggcagacccacccttaatctgggtggccacaatctaatcagctcccagcaaagctagaatataagcagacagaaaaatgtgaaaacagagactggcctagcttcccagcctacatctttctcccgtactggatgcttcctgccctcgaacatcagactccaagttcttcagttttgcaactcagactggctctccttgttcctcagcctgcagatggcctgttgtgggaccttgtgatcatgtgagttaatacataataaactcccctttatatgtatgtatgtatgtgtgtgtgtgtgtgtgtgtgtgtgtgtatgtgtatacatatatatatacatatatatacatatatatatatattccactagttccacttaacatttcaaccccaactcctacctctgcttacatcccttctccttatcttgatgtgtttgtttattgttctataacatgtcacaattttacatacccactgtgtttactgttaatgttctgccttctcatgataacatgtgagccttaggagatctggatcccttgtctgtttatacacagatgttaccttaaacacgtataacagcaagtggcatatagtaaagtacaataactttttataaagtctgaataaactccaccaaaattccaatgccactggacacctcctatttcagatggtgaatctcatgcttcactcccaacttgcccaaccttaaatctgcattttccatcctgcctcaaactctgggcttcgggcactgaagaaacacccactccagaatcagtatcaaggacacgtgttcagtaagtatctcttagaaataaaataacattctaggctttagaattcaaatagtttaaaatacatctcttaaatgccacaatattgtaatctaagtgagaagactatgcacggtagcagaatatacatggccaaggaaggagaggtgggtatgggatggggggaagataaaatactgctccccgtttaaaacacacattacaccaccaccaccattactgtcaagcacatcatcattgcctacccccaccaataccatcaccgctatcatcaccagtattaccaccaccaccgccgccacaaacactaccctcaccaccaccaccaccttcaccaccaccattaccatctgcaccaccaacttcttcaccaccaacatcatcaccattaccaccatcaccaccacttttactaccatcactgaaatcatcaccatcaccaccatcactgtcactaccaccatgatcatcaccatcattatcattaccaccaccatcacctccaccactttcactgccaccactaccttcaccatcaccaccattaccatcaacaccaaaactgaaaccaccaccactacaaccattaccaccaccaccactgaagcaatcaccaccacccccctcaccaccactcccaccaccccatcaccttcaccaccaccaccgtcaccattactaccatcaccatcaccaccatcctcaccagcaccatcagcaccacaacattaatcaccattaccaccactatcaccaccaccatcagcaccatcaacgccaccaccatccctatcaccatcaccatcaaatgcatacatgcacagtctttccaaccctcagtttctatgaatgaaaaaactgaatctgtcagcaggtgatagaataaataataatccacaaacctattagctcacataatacaatttacattgtgtttgtattgggttacagtagacatttaaaatatttcagtaagacaataactgaaaagctaatagtaagcaataatttgtattgagacctccactggagtcaggttgtgctcgcaatctgaatgcctttgctcatgacgttaccagagggaagagagaaaggatgttacaatatggtctctgacaataagctactgcaggggctatcaaatacaatgatttttaaaaatcctaatattggatgtataccatgcagtttgtgcagatagcagataacacaatggttcacaagaaataaaagaatctaaaatataaagccaagcaggtctcataagaacttaaaataggctatgaaaaaaattgaatttagatgaggtgagaggaaagagtattgtgggggaaatatatttttcaaagtcactggaccctaatatttgtggaatacaaggtaagggttcagatggagacccacatgctaggtgtctaaatattttaaaattatcaaacaacctaacaaactgtttatcattccactctaataaatagctttaaaacaacaacttgaatctgggtttaaattcagcagtatcaggctctcaaaaagtctaagctggaacatggagcagctcctgtccttctctaacctccctctgcatcatctcaccctgcaagggatctctttcctgcacttttggatacactggtctaaacatctaaattccagccatattcgacctctgcaaatccaccttccagttatccctgaggcctaatggttcgcataccagctgcacggtctgccctcaggaggagtgaacaatgaacacaggaagaggccacatagatgctggaaggtccaggatcccagataaccttggtctaaaaggagcacgcaggcaccaattagcatgtccttagccccatgactttcttggcctggagagaggtgcttggccagaggagaccagaacagggacctctctaaaactcagagcccagggcaagtctttcttgcctgggtttaagtgtactgagaggtgaagccagccggacttcctgggtctagtggggacttggagaactttcctacaaaaggtttgtaaaatgcaccaatcagtgctctgtagctagctagaggtttgtaaaatgcaccaatcagcactctgtaaaaatgcaccaatcagccccctgtagctagaggtttgtaaaatgcaccaatcagtgctctgtaaaatggaccaatcaacactctgtaaaatggaccaattagcactttgtaaaatggaccaatcagcaggacatgggctgggacaaataagggaataaaagctggccacctccaaccagcaacagcaaaccccggtcagattcccttgaagtctgtggaagctttgttctttcactcttcacaataacggttgctattgctgctgctgctcactctttgggtccatgccatctttaagagctgtaacactgggctgggcacagtggcgcacacgtgtaatctcagcacttcggtaggcccagacaggcggatccccaggccaggagatggagactatcctggccaacagggtgaaaccccatctctactaaaaatacaaaaaaattagctaggcatggtggtaggtacctgtactcccagctactcaggaggctgaggcaggaaaatggcgtgaaacccggagatggagcttgcggtgagccgggatcatgtcactgcactccagcctgggtgacagagcaagactccgtctcaaaaaacaaacaaaaagctgtaatacttatggggaaggactgcggctccattcttgaagtcagtgagaccacgaacccaccagaaggaacaactctggacacagtgctacttcaagttaaatatcagagcaatttcataagaaagtatagggtaaaacagtactgaacatgtccgttctcacagcattttgagttcagaataaagcagtgatgcctctcattaaaaattattttgatatatatttttattttgtgagaaattgtatctttttcttaaaaactaaaaaatcctaaaactgacattaaaaatattttatgtaaatattaaaaaacagtggattgtcacctacgaggggtaagataattttgcttatgcatactgttcagagacagagtctccaaatgtgttaattcaaaacttaatttaaaaaaatctaaagttgaatattttaggctatatttaactgcctgtatataattttattaaagtaatattatctctctatatcaccaacagatgaggaataaagtgaacaacataaactgtttaatagacgattgtaattacataaaagcaatagaatgaagatgaaacaacccttcccattcttactctatggctatggaatttggagtctatgatgtcaaaaaaaaatttttatcatttaaagatatttatatatttacacatatcaaatttcagggaggacagcatataggcatgtgggttcggaattgtgttggttaaagtgacatcagtaaagcaagggaaatgaaagagtatcagtcaaggagaatctctgaaagatatctttccaaggtgtgtcctagttgatcaatcatgggcttgcagattgcttttaataagatagtgtaacaattggttcaagtttgtttggataaatgtggatgttttgtctgtttttctcattttgtttttgatatttccttgtttggaggcatggcttgacctggttctcagaactgaggtgcaagtttgcagtatttcattaaagaaggaaaaatgtctactcacagacttggtatgcttttcctgttaatttcctcataggatactggcttgttatgcttgttacatgctgacagatggttagatgtagaatttatcttcaaacacagccacattttttcgtgaagatttttgaagcctagtttaacctgtttagcaaatgactatgattatgttcccattaatttcatcatgaaagaaaaaacaaaatgggttattccaaagaatttggtttttagattatatgaactttgggctgcatttccttcttaaaggcagacctttcagactggatttctgtggacaaggactgttggtgtttcctgtagttcggctgattatagagttactaagtcagttcaagtgtttccatagagcctcactgatgattcgttgagattggccttgactttgctggttgagttgttcattgactttttttctcttttggttatcatatactttgttatttttttccccagtggaatctaaaaatccaactagactttatcaaaggttaacttcatcccaacagaaaaatatagtgtctgctggaaagaatactacctgcactagctatttattttttttaacctcagatatagtgacattccactttgctccaataataagaagcttgtagaattagagaatttgggttttttttaaatttccaaaaatttggtcagacgcggtggctcacgcctgtaatcccagcactttgggaggccaaggcgggcggatcatgaggtcaggagatcaagaccatcctggctaacacggtgaaaccccgtctctactaaaaatacacaaacaaaattagccaggggtggtggcaggtgcctgtagtctcagctacttgggaggctgaggcaggagaatggcgtgaacccaggaggcggagcttgcagtgagctgggatcgcgccactgcactccagcctgggcgacagagggagactgtctcaaaaaaaaaaaaaaaatccacaaatttagttttattataaaaagaaatcagtaaactacaataatcaaggatctatttttcagaggatttagaaaatcattttgatgacaatgagaagaaattttaagtgaaaaagaaagcatgcgatttcctaggtcagtgacgagggggatataaacacatgaaataaagcaacaggaataaaaagaaaaaaataatttttttattattatactttcagttctgaggtacatgtgcagaacgtgcaggtttgttacataggtatacacatgccatgtggttggctgcacccatcaacccgtcatctacattaggtatttctcctaatgctatccctctgccagcacccccagcccctgacaggcccaggtgtgtgatgccccgcccccacctctgtgtccatgtgttcctttttttttttttttaagacggagtctcgctctgtcacccaggctggagtgcagtggcgcgatctcggctcactgcaagctctgcctcccgggttcatgccattctcctgcctcagcgtcccgggtagctggaactacagaccccctccaccatgcccggctaatttttttgtatttttttttagtagagatggggtttcaccgtgttagccaggatggtctccacctcctgacctcatgatctgcctgccttggcctcccaaacccgtgtccatgtgttctcattgtttaactcccacttataagagagaacatgtggtgtttggttttctgttcctgtgttagtttgctgagaatgatgatttccagcttcatccatgtccctgcaaaggacatgaactcatctttttctatggctgcatagtattccacggtgtatacgtgccacattttgtttatccagtctatcattgatgggcatttgggttggttccaagtctttgctattgtgaacagtgccacaataaacatacgtgtgcatgtgtctttatagtagaatgatttataatcttttgggtatatacccagtaatgagattgctgggtcaaatggtatttctagttttagatccttgaggaatcaccacactgtcttacacaagttgaactgatttacactcccatcaacagtgtaaaaacgttcctatttctccacatcctctccagtatctgttgtttcctgactttttaaagatcgctatttaactggtgtgagatggtatcttgttgtggttttgatttgcatttctgtaatgaccagtgatgatgagctttttttcatgtttgtttgccacataaatgtcttcttttgagaagtgtttgttcatatcctttccccactttttgatggggttgtttttttcttgtaaatttgtttaagttctttgtagattctggatattagccctttgtcagatggatagattgtaaaaattttctcccattctgaagtttgcctgttcactcggatgagagtttcttttgccgtgcagaagctctttcgtttaattagatcccatttgtttattttggcttttgttgccattgctttcttcacagaattggaaaaaaactactttaaatttcatatggaaccaaaaaagagcccacataagacaatcctaagcaaaaagaacaaagctggaggcataacataattaactacatagagaatccaaagcaatctcaaaaaaaatagaaaaaataaaattactacaataaaggtaaatttacgaggctcacaggatgcgatcaatatgcaaagaccaattatatttttatatatgagcaacaaaaattttaaaatgaaatttaaaaagaataccattcatatacatagtaacataaagcattaaaaattaaattcttaagaataacatatttaaatgtgcaagactgtacctataggagacatactgagggaaatcagagaagatataactgaacgctgactatactgtgttcatgttttataatatataaacttgttaagatgtcacttctttctaaattaatctacagacttaatgtagtcccaatcaaaatcttagcagtcattttttttgtagaagttaacaggttgactctaaaatatacaaggaactataaagaaataaaaatagccaaagcaatttaataattggcttttactatttgatttcaagacttgctctaaagctacagtaattaacagtgatattggcataaggctaggcaaaatgatgaatggaaaagaatggagagtctagaaatacttcctctccacccctacacacacatatttatggtccatttgttttcaacaaaggaaacaaagcaatttaatggggaaaaggatagtcttttcaacaaatggttctagaatagtagcagatccctataaagaaaatctaccttaacctgtactttatatcatatctaaaaattaactcaatctatgtcatgtacttatatataaaatttaaagttatcaggcagctaggaaagaagtcaaaagataatatattgttataaagagatttattagaaaagaaataaaattaactagccataaagaaaatattgataaattagacttactcagaattaaaagtgcccatcaaaaggtagagatagacagtaggcaatgcaaaatacttgaaatttctatatttgaaacaggacttgtatccagaatatattttaaaacccatcaaactcaataatagtgataataataattatttaaaaattaattttaaaatggacaaaagattttaccagataccaaaaaaagaggactacacagtaaacaactgaaaaggcaattaacattagtcatctaggaaatgcaaatcagagccacaatcatttccatttcacaagtattgaagactcacaataccaaatgctgaaataactgaattctaatatatggtgatgattgtgtaaaatggtaaaaccttcttaagaaactgacagtttcttacaaagttagatgtacatctaccctacgacttaacagttctattcctagttattcccccaagagaaataaatgcaaatcttccaagaaagacatgtataataacatttatagtaactttattcataatagataaaacctggaaatagcctccaatttcagaaacaaaatgagtaatcaaattgttgtattttttcatgcacctttttgtttattgttttcaaattgattttatttttagaatagttttagatttatagaaaaactgaaaagatagtaaagacaattcccatatacccaatatccagctttccctgttatcatcttacattggtatggcaggtgttacaatcaaggaaccaaacttgaggcagaagaatagggtctagaaacaggaaacctaaggccaacccatggctgccttcttggaaatgaactgagaggaaaaccccacctcaccatgaccacgtaatgttaggagccaaatgcccctctctctccaaacctcccctcccctacctagtgaatgagaatgtttgtaactggtccattctggaaccttcatttgcatatacatcacaggcaggatgcctctgattggtcctgggcagaatcctgccactgactggtcctgggcaaaatccttcatttgtatagggtgtaacttatcagaggcctctaaagggtactgaggggttttaccatgtttttaaattttgattaaaaacccaaggaacattacagccagggctcttgagccacttgcttgggcctgctcccactctgtggagtgtacttttccttcaataaatctatgccttaatcttctgttgttttgtttctgtgtttttttcaatttctttgttaaatatgccaagaacctggacaacttgcactcaagacttccatccagtaacaaactaatacactgttattaaccaaagctcatggtttactcagatcttatttttacttcatctcctttttcccatccaggatactgcattacatttagacatcatgtctccttaggcttctcttgcctctaacagtttctcattctttccttgttgttgatgaccttgacagttttgaggagtatcagccatgtaatttgtagaatgtcccttaattgaggttcatctgattattttctcatgcatagactggtgttatggttttggggaagaaagagctgtgttgatcacattataccgagaatatatattctatgaacttgatctatcactgttgatattgaccttggtcacttggctgaggtggcatttctcaggtttctttactgcagttacttttttttttttttccctttccacattgtgctttttgggaggaaggcgctcagtacagctcgcacttaggtgcagggagtcatacatcccccccttgaaggtgaagtaaattctagtatttttatattaatgaatactcagcaataaaaaggtaaaaaggacagaaagaaaagggaaggagcacaactgagacaaggaacaacatagttgaacttcacaaacattaggatgtgtgaaagaatccaggtacaaacgtgtacatactgtaagatttattcatgtcaaaaacagacaaaaataatctatggcaattagaagcagaacaatgcttgcatcaaggggcaggtgattgaactaaaaaggggtaccagggaaatttctgtggttgataaaatgttctatgtcttgattaggatgtattcacaacattcagttagctgtaaacttaaggtcttcgttttcacttatgtaaatcatttcttaattgaattttttttcaaaaaaggtcttctgcatgtaatgtcaaagaagtcattaacaattctggttaaaagcaatttcagtacaagcgttgttgcagatggttttttgggagcttttagttaaatttccctaaaagaccttcacaacgaaatggagtgagtgaaagaacagcacttactgaagatcactaattatacttgaaaattagtgacattatacttgaaaattagaagacagaaatagaggagtaaagatctacaaagaacaaaaatcaaactgcaggaatatacagtaacagtgctgacctcataaaggaactaaaaatagtttattgagcacctaactgttacagcaatccaaatgggagaaacaaaatgcaaagagatgactaatgtctgccaacacgcttacctctagacaccagtctagcaatgtaaaaatcttacatccttttatagtgatctttggagatttgctaaatccttgaagcactctagtaagaaatgaccccttaagtgttatggcttttcaaggacactcataggtagtatggaactataatttttaaagcatgtgtaaaaagacatataaaacaatatattgtatagcacaaaaaatcggggcacaattctcacggtcattagttatcaaatgagttggtggctgcatctcattttgccttctgtaatttgagaaaatctctagaaaactaacaagaaaacagagaaaatagttaaaatagttaacaaactaaacttctctgagaatatataaggaaaattatccagcttgctgaagacaggtaaatcacaaaacttcttcctgttgaaatacaaaaaagataatctattcttcatggaaattggagttctcagaaaaactaaccactctgggatttagcactgaccatgaagcaaaaaagaaaaaacactggtgcctttactttgtatatttgtccttggatgggagagggtcaggatggttatacaaattttttttcattacttcatttacattaagtctagaactataaaaaagagcttggaacagggagtttgaggttcagagactttaaaaaccgcatttaaaaatggtgggactaagcatttaattattaaagcaaaaaccagcctttgaagttttgaattaaatgaaaagaagtattaaaatattaatgcagaaaatcatattctagtgaaaaacaagaaaaatacagactttaatcacaccaactttaattaaatcttccttctagcacatctagactttaagcaatcacttattctaccaacattaattgaggacagatattgttctcagcacttggttttctgtgatgaacaaatgaaattccagctgtcaaataactcactgtttgcatttttttggatttttttttttttttggttttgccttgttttttggaatagtattatttcaagactgggagagagataagatcttctctcagaattccttctaatctcataattttattaaacatcttgttgccaactcaagagatcagcatcataactcatacacattggtaagagcttaaataaatatatagttattgttgggctttgagaaaggatattaaattacataccgagggagctaaggccaacataaagaaacacttacatctctgttttcacattgcatggggtttttattccaaagaactcctgagcttaagctatttatttaagcatttctccaatatcacaatatcaactggttattgcattctgtgtaccttgattttttcactatttaatgagtattttaagttgtttcatgttaaactcaaagtgtttagataactgaacagttactcagacaaatgagggttagttttctttatatctctgtatctataagtaaaaatagagatagatgtttcctactaagaaatggtaggggggcctcatcaatccataaaatcagcgaataattttcattgtagaagtacatattgcctctagctatgagtcctcactttaatgtgtgaagtagaatttctatatgaggaataaagaattgctggatcagatctttccatgagactcaaggattgaattttgtcataattctttctgaatctgccattcttattttagctaaaattgttttgccttgagtggagctgagctggggaggcttaacacattgtctggcaccgttatttgggattcactaaaattctttattttgattttaaattgtttccaaaaataacttcagagaccattaggtaaaatcatcaaaaatattcaataaggaaataattgccagagttaaaagtcgaagttcatgtaccctgggtctgggatggaaagttttacacacacgcaaacacacacacacacgcgcgcgcgcacacacacacacacacgtgcatatttgaaaatacttccatgattggtcattgctatcacataacagaaaacagctgcattgagtaaagtaacaactggacagccattgtaaccttagctttccatttgatactcaggagagaaaccttcctctacatatgataaaaaatatgaccactaccatgattagtaaagcagtgaagcagcaaaacaactcacttctcatctctcagtctccaccctctgccccttttggtcagttttctcaaggccaatattgcctatctccacagggcaattggactattacataacaggcgctaatacttgtttaagaaaaaacatatatgatcttttaaaatgctcatccccaggaagcttaacgactttaaaattaaaacaaggcagccatggaaaagctattattggtagaactacacaagttgacttttttcttaactgtatttatattctggggtcgatttggtagccttagtccaagtgctccaatgatagtttcagggatattttcatctctcctcctctcttgcactggcttttattttcagtacttcagtcggctttagatgacacttttatctgttagggtttcaaaatacaacagctggctgggcgcggtggctcatgcctgtaaccccagcactttgggaggccgaggcggccggatcacgaggtcaggagatcgagaccatcctggctaacacggtgaaaccccgtctctactgaaaatacaaaagattagccgggcgttgtggcgggcgcctgcagtcccagctactctggaggctgaggcaggagcatagcttgaacccaggaggcggagcttgcagtgggccaagatcgcgccaccacactccagcctgggggacagagagagactccgtctcaaaaaaaaaaaaaaaccaaaaaaaacactattgtaatttctaataccgaagactaattttatttttaaagtttgtataaatagaaattgtatagcatatattttctttcacgcctggcttctttcagtcattattatgcttttggcatttatccgtgttactgcttttagttgtagtgtatttattatccttactatatagtattctattatatgagtataacaatattcttttcttaattctattgttgataaacctttttagggttattttccatttggggatattgcaaatagtgctatgatgaacttccctctatttttacttctcacgttttgcacacaggtgaacatttcactggataaacatttcatagtagtagaattctaggtcatagagtatgtaaatgtttagctttaatagatatcagcagccatttgtttacattggtcattgtaatttaccctcttaccaacagtgaatgagaatatcgattgctccatttacttgcctacttttggtattttgggtctcgttttgttttgtcctggttgtttggctttgaattctagtaggcatgaagtgttatctcattgtgattttatttgcattaggctaatgattaatgaagagatcatgttttcatgtgttcattggatgataaaatttcctttttatgctaaatatctgttaaatgtcttggtattcatattacgaattcttattgtcagttgttttcttattgctctttaggagttatttatatattcttggacataagcctttcattgcattatgtgtattgctaaatctcatgctctgtgatttgtaattttactcaattaataatgtcttgtgataaataatttttatatttattaaactgtttatcaatcttcattgtcagtgtttttatttgacctttaagaaaattttgcttacacaatggttacaaaatattttcctacatgcaaagttttttatttttttactttcctcatgtgtatttaaaatctatctgaaattgacttttaagtatagtccagtatatactgtactgattgtgtatacatggtaggagtcaagaccattctgttctctaaagctgttctacccattcattcatgtattttattatgaataatgaataataaaatttcctaattgagaataaataattacatttattcagactgcattcttcccctatgtcacagcatatcataaaacaaccttgtgtatatcatctatatctaaattatgtattattccattagtctgtaatccatttttaagtgtcatgtggtttaatattaagtcttagtatttgatgttgtaagatttcaattttgttttcttcttcaagattagtcttggttacttgggacccttcatcagtactctataaacatttgaaagttcttagccaggcctggtggcttgtgcctataatctcacctacatgagaggattgattgagcctagggggttcaagtctgcaataagctacaattgcgctactgcactccagcctcagtgatagagcaagaacgtcatctgtaacaaaaaaaaaaaatttcttgttattatctacaaaagaaataacagaaaacttgctagaatttagattagaatttgattggttttatagataaattttagaactgatagctttacatgttgaaacttttaatccataaacatagcagaacacagcatttcttcctcattaagtttatttctagaaatttgattttcttgttattataaactgttcttataaaatttcatttaataaaagattatatttatttgacagatatggaatattcatattttctatttcttctgagtttatttagtattataaaagttgcaatctttctcactgtattaccaatattgcctgatattagctgactatactaattcttttaaaaaatagtgtttgttacatttttatccattcctctattttcctttcaaatcattatatatagggtctgtatcctaaaatttaagggtttatggctatgtaagccacatataggggttgttattgtttgttgttactgttttcatccagactgttaatctttttttaattggataatttaggccatttatatttaatgtaatactgatatatttaggttacagctcacattttactatttgatatgtatttctcatcttttttctgtttaatcttctgatcttattttagagtattttttatttttaattaataaatttattttaaaagtaacccataaaaattgcatatatttatcatgtacaacatcatgttttgaaatatgtacacattatggaatggctaaattgagcaaattaacatatgcattaccatacatacttattttgtgtgtgtatgtggtgagaacacataaaatctctcttagtaattttcaagaacacaatacattgttgttaactatcatcaacatgctgtacaatcaatctctcaaacttattgcactaactgaactaaaattttggatcttttgaccatctgcccaaacacttctgcccccagccctcgatgtccaccattttactctctgcttctattagttcaacttttaaaaattccacataaaagtgacatcatgtggtatttgtctttctttctggcttatttcagttaacataatgtcctccaggttcattcatgttgttgcaattacaagatttcctttgttttaaaggctaagcagtactccatagtggatatattattatttcttgtttaattgctcaatattcatattgacattaaatatttttcaacattgacttgcattatttttactattttcagtgatttccccaaagattaaaacataatttttatttattataggtcaatgcatcagttattttactaatctatatttagttatattatttataatatactaatgtatatcaatcattttgctttccacgcaactctttagaactcaaaaaaccttgtaactgcatttaacacctcatttttggtgttaatgttagttgttcatatatttaaatcatcatatcagattatatttttattgttttatagtaaatattagtttatattttctcatgtttacatcctcttactcttcattccctcttacattttcatgtttccatcatgttttgtcatttttgtgaatgactcttatttttattttgtctaaaacaaatcttaatgagaataattattttgatttttgttaaccatatccctttttttttagtttttttctttttattttccactcattttttactctggaagtttcagtgatttatttttcagttcaccaattccctcttctactacatcctagctactgtgagctcatcttttaacttcttaattaccattattacatttttcaattctaagatttttattatgatttcctgaattctacattatggagcatactaatcttggttatttttgtatctgtttttcatacttctattaactggatcattggtaagaagtgtgctaatttttttcttgagtattaaatattatatatgaaaaatcagggagactctggattgttctcctcctccagaaaggttgcaacatgtcctctgatggtgagattcagtcaaggcatatcatcttaatctaatttaggacaaggctaacttaagctaggttagaatgtgtttaaggctctgtctccttgtagcttacactcattcctaggacactgccctccagttggtcaacctgaaatcctgaggtttcttccgtcaccgttcttgagtatgattactgtctctaaatatttccggaaaattccattatgtttttcagtggctttctgatgtgcttcttatccttctttagaattcagcaaacgcctctaagggagaaaaaaaaatgtcctaattctttatctctcttttctcaacaataacttgatttcacatctcagctgttttgaagtcacaaactttagcttattcctctttagtcctgtgagattaacaaatagtgtgctgatttctctgctttttttttgggtgggggtaccaaatttctttatttgaaggaatggtacaaatcaaagaatttaagtggatgttttggtacaacttatagaaaaggtaaaggaaaccccaacatgcatgcactgccttggtgaccagggaagtcaccccacggctatggggaaattagcctgaggcttagctttcattatcactgtctcccaggatgtgcttgtcaaaaagatattctgccaagccagattcgggtgctcccatcttgcgcaagttggtcacttgatcacccaattctttgatggctttcacctgctcattcaggtaatgtgtctcaatgaagtcacacaaatgggggtcatttttgtcagtggccagtttgtgcagttccagtagtgactgattcacatttttttccaaatgtaatgcacactccgtcgcattcagcctgctctcccagtcatcacagtctggtttcttgatatcctgaaggaagattcagccacctagttggttctgcagctccatcagtttctcagcatgttccctctcctcatgagattggtgaagaaagtatttggcaaagttcttcaaagccacatcatcgcggtcaaagtagtaagacatggacaggtaaacgtaggaggcgtagagctccaggttgatctggcggtttatggcggcctctgagtcctggtgggagttctggcgcacctgcgaggcggacgcggtcgtcatggcggcgactaagcagaggcggcggtggcggcggcggtggctgcgcggcgctggagcggcggcgggggccctggggcagtccgagggtgcggtgaagaggtgacggagggctggctatggacggccggcccgggtgcgggacgagcgccgggttccgtccaagcactgttgaagcaggaaaccccgacgactctccgcgaagaacgtctctctctgcttcttatttgtatttctccacttaaaaccttggcttctaatttgtggaccaattaaaaaatgcccaaaggagggtgactcttagaatgaccttgtaagtttctgagttttttttttttttctgcaaacccctcatctttcaatttctagttgctttggcagctctccgctgtattcaaacaaatggtttagtcaaatttttctctttgttttcaagttggcttattggttttctgtaagctactccataatgaatggaagcagaagtttcaaagaatagctgataaataaaaatgttgtataattgctgcaattattactgttgttgatgcattattatttttttaattccatagaaccaaagcttctacactgttttcactaggcaagagtaagtggcaattgacaaccaaaaattgaaaacccttatctgttacaggtgttcaggtatttgaggtaggcattagcttttagtagggcatggagcatatctcaaatgcaatagcttcctatgaatacctcatcaccagtcaccagtattgctataaaatctaaaaaattcagctttttttttttaatgtagctaatatttggccatctataaaagtcagatgtgtaatctttgcacatccccaaaacattttacgctgtatttatcaatatgaaatatataatttttaattgaaaatacaaatctcctactcctcaattaatctatatttaaaactttattttttcacagatttatagagaaaactttttgccctttagtccatgtgccaaaaatacttttgggtataaaaatagttctatttcatcagtgattaacatatacaatatattacagaaaaaatcttttccatattatattttacctgacatgtgtatttatataatatccaaaacttttcattgtgacaatttttttgtcatcttgagaatgtgtgtaaatatcactgagtgaaatcaattgctttaaactataatgtgatgcaactatgtgaagtggctgctttagtaaaatgtagttttaatatgaattaatagaagtagagtgccagaacaagacatgtgcagatcctgctatgttctgttgtgatcaggacttacttcaattttggtactctgctttaaacatcatacattaaaggaaacatcaattataacattgcacacagtgtcactagatagtgaaaggctcttaaacactgtttgggaagaataattcacaggactgaaatgaagacaagatttgtcaagtaacacattctctaatatttagaagtctataacacacaggcttaagagacatcctgggtcattatgggggaaagaatcccaactggtcaacatatgagtgaaaaacattttaataactggaattgtactgtcacagataaattaatataggaagtaaaaaatgtataaacaattaaaaatatttgatgatttcacagagatggtatcaaggggataaaaacatcctaccaggaataatctaggtgattcctaagatttcttccaattctaaaactgagattaaacaacgttgtataaagtcagatctctgcttttctttctcatttagcatcttaaaattcatttatgtggaacatcaatcgttgaactgatttgtctcttacgatttgggggaaggattgaaatttgaaagtgataatatgtataattttattatatcatagtatttagctcaaaaatttctgctgtacgatcatttctataactagcaataataaaggagataggacccatggttcaagatcttaaatcaagctaaatttcctgtcacaaggctggcttttccttctgtgcctaataatatgttcatcatttccttctgagacctcaccaggggcatgtttaacattcatatttctgccaagctgtcatgttttatctcagatgctgtaagctttctctaccgtgttcctcacagccatctgaattctcaccagaatttcttttcactccacattgccacaaatcatttctttgaggcaatctgggttttctctatcatggtccccaaaattcttccagcctctgcccattaatcagtctcaaaaccacttccatatttttaagcatttgttacagcagcacctcatttcctggtacccaaacctgtcgtttcttggggctgccatagctaagtaccacaaacagcgtggcttaaagcaacaggaacttactctttcacagttctggaggccaaaagtctgaagccagggtgttggcagggtcattttccatctggagactctgacagagaatctgttccatgccttttgggttataatgcttctgttccaaggcgttccttggtttgcaaatctatctctccaatttctgccttcacggccttcttccctgtgtgtctttgtctctgtgaatgtctcctcttaaaagaacacaaatcattgaatttgaggcccatctaatccagtatgacctcatctgaattaattatatctgcaaagaccttatttccaagtaaggtcacattctgaggttccaggtagatgtgaatttgggaaggacactgttcaatccaccatataggttctgtgttccttaaggtttgtaccatgtgtggttctagaagtcaacacagtgcctggcacctagaatgaatgaacgattcagtgaatttcctccatcactaactctgtcaaataagaacagttaagtgtcaaagttgaggtggatacattaaataatgctcactttatttgagcaagatttaagagtcagccttgactttcaattctcttgtgggccacataagcattgcatgtcacactggggtctaatctcacttgtctgattgttcccaaataagcttgcttgagaaaaacatcccctccatctactgagatagaagtttgccatttgcagttgaatctatgctattctggaaagatctgtatcacattctttactctggtccctcctacaagagaggatcctactagatcatcaacatttctgtatattaggaatgtgactgtgtgacctcagtaagccacttaatcttttttcgctctgttgttttgtaaaatgggattattaatgttacctactttgtagggttgctataagcatgaaataagttaatttcttaaagtactcaaaactgtgtctggcacagagtaaatccatgtttgtttaataaatagtatttaatgtcaatcaatcaaaatcaatgaagtttctctgtaaacaaagtattaagcagctaccaagttctcagaaggggttgcctgtttcttataattttcttagagacatagcaacttagaactggtttcatcaaggtagttactaaattcagcgacatgaaggaaagttttctgagaagcattttcctggctaagcttaaaggtctgtctctcaaacacttctgttttggagatatgacattttatagcatgaatggaaaaaattgtctggaagttatagtgtttttttaacataacactcactattgtacctcacattttacggtttacagaatgtttgttttaagtagtcagtagggttgcagaaagtataactaacttgcatcctgatttgtgaatcgcgtgtaatctgagcgcatctgaaagcctgttggtgtccttttcttggctcatggctcacatactcccttgaagagctgtcaaagttggcatggcttaaatgtcattttttaaattactaaggatttaaagtcaggctaaggttttgtgtgtgtgtgtgtgtgtgtgtgcgtgcatgtgtgtatgtgttgaagatgaaagagtttagcaaatatcagtttattgactatgaaaatgtatccagacttcacttaaaccacttttctcacccacccatagaactgtttcaatcaagttcaatcaaggtgacactaatgagctaacagtcttccaggtagcagtgacattgacatcagaaacattctatagatcttagccttaccttcttatatgcatcccctcccccatcttttgtctctttccagagcctgaaatctgttattattcctcttgggaggtccgtttacattgaacacacatctggcttaattaggttgacagctgctacaggtaccgttggacaaggtccagccatctcagtgcattcccatttacttgacagcttaacctttcacaatctcatcttcagagtgcaaatgaacttgagagatgtgcttttattatttgttaatacatgctcattctctaccttgccaccaaaatcgtaatcaacagagaccacactaaaaagtaaagggtatttccctaatgccaactggtgaactgcaaagaccaaactacccaaacctatgaaaacttggcaaaaaagcataataagaagtggtccagggcagttggagaaaaggctgagaaaacaatcccactttcaagcttatggcttgagtttgcttacataaaatctttaggcagtaaaaagtgattacagttatttctgccttcagccacagccaacaaagaaggtggtcttcagattccccacatacactgatgtttttcatctacgctgttgtacttctagcaatggagtgaccaaacattttgcacgtgcatacaggaataatctgtttgctgcaaagccacttggtctgtgttttttttttttttttttttttttttttttttttttttttttttttttttttgagacggagtcttgttctgtcgcccaggccggactgcggactgcagtggcgcaatctcggctcactgcaagctccgcttcccgggttcacgccattctcctgcctcagcctcccgagtagctgggactacaagtgcccgccaccgcgcccgcctaattttttgtatttttagtagaggcagggtttcaccttgttagccaggatggtctcgatctcctgacctcatgatccacccgcctcggcctcccaaagtgctgggattacaggcgtgagccaccgcgcccggccttggtctgtgttttaaaccacctgccttaaatgcctttgcagttgttttaattaattcatgcataatttttttccactagagcttcatgtagaaacagcattgagaataacaactacttttggctgcctcaacccaagcccaagcccaaattaataaaagcagagtcaattccaaaagtcccttccaaagaaaggtggttagctttttcgtaccatatttacttacagcaggaaagtcctttatttaacaaattactatttgacttcctggaagtttaaacgtttgattctctggggcgattgtattttcccaagaagcaacacctttgggaggccagaggacaaaaggaaactgagggtcattccgttttcctggaccatgattttcctttggctattattttgaatcattatagctaaattgtttttcttctccaagaactaaaagtagatctactattcaatctagcaatcttactagtgagtatctacccaaagaagaagaaatcattatatcaaaagaacacctgcatgcgtatgttcattacagcacagtacacaattgcaaagccatggaaccaacataagtgtacatcaattgatttttgaataaagaaaatataatatatatacactatggaatactacacagccataaaaaagaataaaataatgtcttttgcagcaacttagatggagctgtaggccattattctaagtgaagtaactgagtaagagaaaaaccaaatatgttctcataagtgagagctaagctatgggtaggcaaaggcaaacagagtggtataatacatacagagtggtataatacctacagagtggtataatacatacagagtggtataatggacattgcagactgcagactcagaagggaggcagtggaggggcatgagggaacatttacactggcatccttctccttcagtgctaacttttcagtcacaatagaacaccttgagctcagggaaactgagggcactcttcctcaaagcagccagagttgcaaggtctgaatggtcatcagattcatctttctgggtaaatagatggcacctcgtaactatgaaatgatgatgtttattaagaagaggtggaggtgcagtgtgaagctctcctgagtgcaccatggtttttggcagcacttcagaggtgaggatggctgccctaggtcaacctgtctggtgtcagaataggttttgcctttagggcagactaggataccttcaaggcaaccaggagtgaagttgtctccctcttgctgtcaagtgactgacaggaatgatttggggccctatactgaactcccagacagccatccccccacaccaagccctggtgctgggaatagcatctcctggcctcctggagctaactcatccagagaaaataagggctagggctcccgggataccaacaaaatcccaaagataaaatattcaggcagttaattctggtatatagtatgtataaataatcatacttcttagagatgctgatctacaataaggaaaaaaacttacttttgtacaaaaccattttacctaccactatgatgtttctcacaatgtactggtagatgtcaaacaataaagaagcaagattagaaaaagttttatcatctttgctgccccaccagtgcattaaacaaacaagaacatttagcatatttatttaagaagtgtattagcaattagctattgtgtgtgctttgatccatttcctaaaatcaaacaaaaaataagataggcagttgagcaagcaagaaatcaatttgtgctgcttcaaatttcatggagatggtcatcaaatttgtgcccttgatcaaacactgcaaaataagtactttttcttttttcttttacaaatctgtataccactcaggtcaaatgcctgtttaatttatagaaacataaataaataaccatacaataaaattttatgatctaatcacaccatgatctggatgttagtcataggccactgtgctttctgcccactgtaaatcactcagcacaacggctgacttatttaccacaaaccgttttaacaaatgtagtcctgcctttccctccatattaattaatacacataacaaaggataacgctatccctacgacaacaaaacccttttgttccctgaagcctccaggcgtccactgaggcccctttgtaggtgatttctcctcgcgattaaaggagatattttgtgtgttccagtgagaactgggagagtaatcctgcacctgttggaggcttaggaaactggtgagtaaacctctcaaacctccatggctgactcagttttctcagcctggaggactggcagagagcttcccaaaactggaaagatgtttcttgaagctttcctcgtgtcacctagagccattcccgttgcatttctgagagcttcgtcttaattttcggttactcatttttttaaaaaggctttgacagtcagatccaacaagtaagtagaaagcatccaatttcagtgtgaaaaatacagcaaaaaaatgaggctatttgatttattttagatcaaacatccagttatttggaaatatctatttttgactaaatttttgttctcatccagatgtttgacatttttgtagacatggattaagtgcctgcattgtattaaaaagacccatttcaaaaggaaaaatgatataatattcttgtaaattcgagtaaaccaaaagattggcttctttcttagcacaatcaaaacaaactttcctcacctcccttataacctcacatcctaaagggaagggggcgatatctataaactatctggggttttttttccataataatattcttacacaaatctgcagcttttggacagtcaaaagagagacccacctggcacacaggaagccacacacgggcagcaggaccactccaggccgtcgaggcccatggtcgggacgctgctcaccatatgtggagatgttgctttcctccagaagctctgtcacattaacgtcaaactggtcttagatgtcattgagggctttggcatcattctcctcagacacaaaagtgatggccaggtctttagtgccaaagcaacctgcacaggccactgggtggaggtaggtgtccgagtcttcaggcatgccatagttaagacgatgttgaatcactcaattcctacaatggttaggaaatgactgaaagtgaacacggggactctgagcaaacctgctgagatacaggcttggggctgcctcagtaaattcctccagtgaagtggatgggattatggtgtggatgatgacaaaagagtagaagagaagttgtcgacagatttgcacagaggccattgaagattttataaataaagaaaaatgtctgcagccagtggtttatgccaaatatcttcccaagcctccatatccctgtggatgttgcaactgactgcaaacagattgatgtccaccaggatccactgctggaaatccttggactgctaatagcgtgacaggcattcttcctgggccatggccaggaagttctgctccatgaggagctgggccggggacatgcagggctgtaccggcttgatgaagattgccacctgtttaaattccagcatgtccaggagatcgaaaagcttgcagttcttctcagtgtccttgagcttgaggtagtcctgctgcggtgtgtgcagcgtgcgcttggtctcgtcatccacaaacacatccatgggaccctgcatggactccctgcacacaggccagatctccttgctcagggtggcactgaacatgattcactgcttctgctggaatatcaggtgggaggcctcccacatgtcccgccacatgtccagccactgcagcatctcatccagcacaaagtgcttcacattcttcaggttgaggctcctgttctgcacaagtgccacgatccaacccggggtccccaccatgacacaaggacagttcatcaacaattcttcattctttttgataaagaggcctccgaaaaacacggacaccttgacactgggcatctacttggagaagtgctcattctcactccttgctgatctggaaggccagctcccctgtgtggcacagatcaggaccgtcacctgtcagttgacaggccggatctgctgcacagtggccggcacaaagaccgctgtcttgcccttcccagatttggcttggcactggatgtccatacccagggtggcctgaagaatgcactcatgctggacctcaggagctccagttgcagcagaaagtcccagaaaccagagctgtggacggaaacgtaggatcccttgacatctttcttacggggaaccagagtgctccctggagacgcctagggctcttcttcataatccaaaagcttattttccacatcctgttctgccatgttgctgagagcagagagaggcagggccctggttcctcattctcctccacatgccacgagggcatgcagttgctaattgtttatatctattataagaattagcagctaatggccaggcactgtgactcacgcctgtaatcccagcactttgggaggctgaggcgggtggatcacgaggtcaggagatggagaccatcctggctaacgtggtgaaaccccgtctctactaaaaatacaaaaaattagccaggcctggtggcaggtgcccgtagtcccagctactcaggaggctgaggcaggagaatggcgtgaacccaggaggcggagcttgcagtgagccgacatcgcaccactgcactccagcctgggctacagagcaagactctgcctcaaaaaaaaaaagaaagaaagaaagaaaaaaaaaagaattaccagctcattaaaaaaaaaaaaaacagactgagaagttaggcagggatggagctggcgagacttctcataaagcagcccctgtcaacaggaaccatcctgcaagccctcctactttggctgtgaattgaggggatgcaattcccaaggtcattgccataccaatgagtagagggtgcagatggaatctggctactagctctgcagggtttagaggacaaagatagaaccctgtggcaacaacatcacacaggcagacctttaaaagactattaaggtacttcactctggggactgggtgtctgaattggggtggtgctgacggacacagtgagaagtaatctgtttaaaacataagcagggcaaagagttaggagtgttttctaggcattttggcctgagcagcattgtaaatggtgtgaacttgggaatacaagaagaggaaaaagaatgtgagtaaaaaacaaacaaaaccaaaggtcagcttggcacaggcttaatttgggttacctgcagacacctacagaggacgtgggcaggtgaaactctgaggctccacaccaagggcgatggcagagctgagatgtgagtgtggtgcatgaatgcaatttaaaatgataggtcttcattcagccttaggttataaggatagaaaagggaagagaaccaaagattgggtgccacagtgctctgacatttcaaagtcaggaagaagagtaggaatcccacatggggattgagtcagacatgatcttctctgagtggttttccttacctcatcatttcccaaattctgagttagattgtgattctacagaagtctgtgcttgtccaccatagcatttatcaagttacatcaccaatattttacactggatagtacattcattctgtaaaggaagggactgtgtcttgctacatcttgaaattgactcaggcaaatggtagactgtaaaaccaccaagtatggaataaaggaagaaaatttagaccccaaagcctacacagatagcctaaaatattatcccatttcacaagtaacttgcgttactagcagcttcaatcctacaatcgatgggctttgagtagatgctattctatcaacacaggtggcccttggtgtatctggaatgtgtcattttacccaagtatgccaagggaagaagaaatcttagtatctctctctcttccctccttccagttttggagagctgtagctagaagtaaatcctctaaagatgaagactactaattacaacatttcacattttgcgtcattctttattcacaaaacatcactgtagccaccaccttagcctctccacttccagcaaagagatctggcctgtatgcaggaagtctatgcaggatcccatggaggtgtttgtggatgccgagaccaagcgcacgctgcacgcacctgcagcagtactacctcaagctcaaggacactgagaagaactgcaagcttatttcctggcccactgcaccccagccctgccttatgctaagtctccatgtcagaggatgacatatacacctgcacgtgcacatgcatattcaccatctggcccttgttccattcaggtgatttatttcttgcatcttgcatctccttattgaattcataagaagatgcatgataattcattttctttgtcaattccctgcttctcattttgctaattcaatgccacactaacacttctattaatttggcacttggaaccgatagatttactgtgtggcattccatctctaactaaacaaaaataaaaccgcagacttggagctttttccagtgtcaaagttttgctgctgctgctgctgctgctgttttggccactgctgcattgtatgaagcttatccacatcctttaatcatatactcatattctctcgaactgaggtatatggggataatacctgaagtttttccacttcatggaggcattgtaaatattcctgaagtgaagaattctgtggttaaagaagtcatcttccttataaatcacagggttcacttgagtcataaggcgacctgttcttctatagcaaatgcttgcttgctgcaaaggcctggactaggagtctcaatagtgatcacccgcaccttgttcatgatatccacatatgtagatgacatctctggagacaattaactctgtaaaattttaggacaatcagttgcctatgaatctgaataacatctgcagttatagcagggaggataaaattagcagagtgatcaattcttatccttcaggatgtaaactaacagctggattgaaaaagaaagttccacaatcaaatttcatcagtgatctgttgcaaaatgagtggttggccacactaaaactcctagcccaggcctttgttgtaaacaaacattggctacacatgagcagatcctccttttcacccaggcacactctgtgatttctaaggacatttgcaaggtttgcagtccagaagcccatttaaacatcaggtatctatcagggttcggagagaagtgcatcaccaattcaaatgccaaccagcctaaaggatgctgggaacatgccccagggtaaccactgctagggtgactgatctatctgaagttcaattaaggaaaaatgctcgtcctcacttccaagttttgaaaacagttgggcatttttgaacattttgaactgtctttctcccctgtaaccacttcttttctgccctgaaatctgtagtgggaaagaaacgtatttagtaatttaagctctcatcttaagaaaagttcaaagtaggtgtggagtaaatgttgtgagagggaaacctgaacctagagttagtgtaataagcccaagtcccagacatatcaagaaagttagcaatgccagaaataaacacagccgagcataaatcaacagagactgtggatggaaatttcactgcgggtatcactgggaacaggaataaaacaagcagatggtaatattggagagaaaaggggaaacataagaagaaaacataaaaagtggaaatatttgactttttcataaagtaaaagaaattttaatttttttttctacttagcaagttctgagtaagaattaagcatcatgatgaaaataaataacattcaagaaaaggattattaaaaggcatagaagaactttcagatttaaaatggagtccccaggcaattctggaaacgaggtccgtttgtatttgcctagattaagccagtattacccaatattagtagcaaaactgcttacctcaaaatccaacttagctttgaggaaatacaaatcagtctacagacatgttaagtttcaacaaatccagtaaatcagaaatatagtgtgaaacaaaattgaaaattaagatttttcaaaaatcatgctcttaggccggcgcagtggctcacgcctgtaatcctagcactttggcaggccgaggcgggtggatcacgaggtcaggagaccgagaccatcctggctaacacggtgaaacctcgtctccactacaaaaaaaaaattagcgggcgtggaggcgggcgcctgtagtcccagctactcgggaggccgaggcaggagaacggcgtgaacccagaaggcgaggcttgcagtgagccgagatcacgccactgcactccagcctgggcgacagagcgagactccgtctcaaaaaaaaaaaaaaatttattgataattgaaaatacgtgttacctaattggcatgttttgcaaaagcaacaaactgggcattgcttttgtttatttatgaattatttcaatagcatgtattgtgtgtgcaccacactcttggcagactgctgggtgccaaaaacacaaagacgcacagcacatggtcccgccctcaagggatctggactagtgggttgttaacttactctggtcacataaatatcttcagatttacaccaagatatttcacatggaaatccacaagtgattccatttcaaatgcgaaacaatctcatccatttatacttaaacatgttttcctcggagacctccctccctgaccttctgaatcggcttaattccattcatgagttcccgtggaagtgcacaaggcacttccttgtgcttcctctaccaaaatactcaaggtagtctatggcagttttgcctactctttactcgccactgtcctcattactgtgacccaaggaattagtaagtaacttatgaatgaatgattacatgatagaagagctgaataaataaatgaactgatcattaaactgaactgtccctgaacaactggacaaaataagtgagtctatttgcctggccctagttttttatattttctctgaaattatgaatgttagtttggactataaattcctttttaattggaatggcaggtccaaatttctctgcttctctcttgcactttaccggataatccacgggtcataggtttttaagctgatttaattcctacagcctcttagaaaatgaagtgcacagcttttacaatgacaattactgttttaaaaattgcttacaacacacaattagacaggagaatatggtataagcgtgatgcagatattttaaatgtgtaatagtgccatcagaagtactgataaaagataactttgttctggtatatgtgaacaagtttatacatcttgaatacttcttgcaggtttattatgaaaatattttctatcttgaacaatggattcattgtcagaaatctgatatgttcagcaacagaaagaaccttgcttttctgatggaggtggattttctgtacaggattagttcaaactagttcctataaaaacacacaagaaaggatacgacacattcttccataatattgcaggaaagtgagttcagaatttaaagattacctcatagttttattaatatactgtaattaactgagcttctccgtttaaattactaattgggggattcctatcacaaacttgagctgcttttcctctcaagaatattcacttctaaacttgttgtaacattctggtctcattaagttaccaattcatctgctatatacagctgtcttcacactctcttccttcataagaatcgcagccaacagaagcattttctatgtttcacaattactgactactacaagggagaccaaggaagctgacaatagctcaactccatgactgcctggacttactaactgtaaggtgtgtttgacaaaatgtagacatatataggattaatggaatgagttgtatttcagaagtaggaaaccttgtcaataccagttatagtttctcttttaaagctatgtaaaagaatattttttattccttttaaagttacttttaatgcatccaatcttctggtttttcaccttagttaaactctcattaaattgagtggttttatctttaatttaggggtttatttctatttttcaaatactcattctgctttcaaacaagagaaacataagcacaggtattttaaatatctaatagtgctatcacaactaccgatgaaagagctgtgttgaaaaataaaaacaaaacacaaaatcttgtttttactcaagagtttcacaataaattcattggtctgtgacaataaaatgtatttatctgttagcaattgactcaagaattgaagcagaatattaagctgagtagcaaggtcaatgttagttcatttatgaaggtgtcacactggtaaataaggaaagataaagggtactctcatactcgagaaatgtatagctatattctccctcaagagattttgaaataatgttaaatttggggaagtcttggttttagacagccacgattttattccgtaaagtttctaaacactctttacctctatagaatcatcaacataagagaaataacagaaagtggaccaaggacaatattgttcttaactgcatgtttatgaaagcccaagcctcaagtgacatactcctgcatttgctttataatacaataataatcaagctcaatttggatgcgcaagttacaatgtgtagttcaccattggacaccaggcacctgggaaatggggttcaaaagaggcacatcttagtggccccttggtgcacaaatagtggccccttagtggtctactagcttctcattggcacctttagcttctgcactatctagaaatgcttgaggatcctaaatacaaaattaaaagattatggtgtttcctcaactcttaattctaatttagaattagattctaagttctaattagtttagcagttgtgttccctcacactggagttctatctatccttccagaccttttctccaaagcagtgtctctgtaggtgttctagattacaaagtttgtgataaatcagtggatgggtaaaagcaatccctttgtcctgtgtactaagctaagctggatagcaccacacttctgactacggggagacatctgaatatctctgggaaactcagaatccaaaacaaggggcttaaaacagcagcaacaagaagaacaaaataaacgttcttgctttgaccaggaaagggagagcattccacacgccatcaaattcagccccattcagatttaatctcaggagagagtctactcctctctttacaccaactctctcaccaagtcctggccagagctccagaattcctgtctccagttttttgttttttgtttttttttttttgtttttttttttagccggagtctcgctctgtcgcctgggctggagtgcagtggcgcgatctcggctcactgcaagctccgcctcccgggttcacgccattctcctgcctcggcctcccgagtagctgggactacaggcgcccaccaccacgcccggctaatttttttatatttttagtagagacgaggtttcactgtgttagccaggatggtctcgatcttctgacctcgtgatctgcccgccttggcctccccaagtgctgggattacaggcgtgagccactgcgcccggcctcctgtctccagtttttacatgagttcatggtgcagatttttgttgttgtcgtcgttgttctgtagaagtccccatatataatacgtacaaggtctggggcataaacatctgtttggaagaaataaaaaaattttttttgaaataacgtaacttgatttttatctcctggcatgccccaatttcagtaaatggcaggaagttcatgttaatcacatccctgtgacccccgtcttccgagggcatccttaacaccagggcatcttcaacaccagggcatcttcaacaccagggctttggtgggcacaggtggctggccctattcctggagatcctgctaccttatcctcagcagggctggctgggtcccctcagcaaggccacctcccagcaagctcccttcaggtctgttgcttctttcctcaggcacttctgactccattctggggtgaagtgacacggaagcatcgagtggtttttgcacagcctctgcggtttccaggaacactccagggcagcttcagggcctcactgtctccggcatcgcagcagcaattaactgggttctccagtgctgggtgctgggatgctggctgctttcacaggcttcacccagtaaataaaaccctcacctgctgaattttcggatattgtggaaactgagagtttttgtctatccccacacactagttagcaataaaacagagtctaccctatgccttttgagaaatgcattaacatgtaatggatattagatatgggatgttctaaaaatcccaaagaaaaagtttaacccctctggggcagacaaaaccgacttataattgaattgttccaatctttgataattccataagcctcatgcaccaagttctttaaaacctaacaggccaggcacagtggctcacacctgtaatcccaacatatttggagtccaagacaggtggattgcttaagcccaggagttcgagaccagaatgggcaatacaacaagacctctgtctctacaaaaatacaaaaattagccagaagttgtggcgtgtacttgtagtcccaaccacttgggaggctgaagtgggaagatggcttgagcctaagaggttgaggctgaagtgagctacgaaggctccactgcagtggagcctgggcaacagagcaagacacttcctctaagaaaaaaaaaaaacaagagaattaatagagagagatcccagataccctttacccagtttccttcaacagtaacatctggcaaaattatagtagaataacacaactaggaaattggtgttgatacagtccagatataggacatgtccaggaccactatccttccctttttaatgcctggggatcactaatatattacagttttgtgatttcaagaattttatataaatggaatctcagatatatatttatatatttatattttacagatgttaatatatatttttatttaatatatatttgtattttatatataaatataaatatatatataaaatacataaccttttttgattgtcctttttcaccgagcataattctctgccagttcatccagataaatggatgaatcctttttaccactgggtagtcttccgtgatatggatgcaccagtgggtttagccattcacccattgaaggacatctggtttttttccagatttgagcttttatgaataaaactgctgtagactgggcatggtggttcacacctgtaatcccagcactttgggaggccaaggcaggaggatcacttgagcccaagagttcaagactagcctgggcaacacaggaagaccccatctctccaaaaagtagatttaaaaaattaatccaggtatagtggtgcacacctgtagtctcagatactcaggaggctgaggtgggaggatcttttgaggccaggagtttgaggctatagtgagctaggatcacaccgctgcactccagcctggacaacaaaccaagatcctatctcaaataaataaataaataaatctgctataaatatttatgtataggattttgtgtgaatacgtatcttcatttctctagaataaatgctcagaagtgcagttgctgtgttgagttgtagttgtatgtttagctttttaagcaactgccaaactattttccagagtggccgtaccattttacatccccaccagcaacgtctgagtgacccagtttccctgtattcttgccagcatttggtgatgtcattattttattttagccattttaataggtgtgcagtgacacctcattatgtctttaatttgcatttccctaatgactaatgatgttgaacatcttttcattttttaatatgccatctgtaaatgtattttaactccttccttccttcctctctcttccttcccttcctttctttcttccttccttcctctctttcttttctttcttcctttcctttcctttcctctttccttctttgtttttttggacaggatcttgctctgtcgctcaggctggagtacagtgatataatcatggctcactgtggcctcaaactccaggtctcaagagattctctggcctcagcctcccgaagctctagaattacagggtgagccaccatgcccggccttcgctattttctaatggaattgtttctgtttttgctgttcagttttgagatttttctatatgttatagacacctgtcctttgtcagattttgttagtttggaaattttttttcccaatctgtaacttgtcttttcaccctcttaaaggatcctttgcaaagcaaaactttttaattttaacaaagactaatttgtcagtttttcctccaagaattctttgcctagtttaggtctcaaagattttctcctatttttttctgaaagtttcaaatgaaatgattagttagagctaattttttgtatgaggtgtgaagtttgggtctgtgaatgtttgattgtcccagcaccatttgatgaaaggctatctttcctccaatgaattgcttttgcacctttgtcgaagaccagtcaggcatatccatgtaggtctttctgagttctctcctctgttccattagtctatgtatctaactctgccaataccacacagtcttgattactgtcgttgaataataaattttgaaaccaggcagccttatgccttttatttcatttttctttttcaaaattgctttagcccttctagctcctttgcctttccactacacacctatgaaaacgtctaaaataaaaaattgtgacattgccaaatactggtgaggttgcagagaaaatgggtcatgcagacattgctagtgggaaagtagaatgggacaggcactctggcaaacaattcggcagcttcttaaattaactcaacatgtagctactataccaaaactccagagagggattgtgtagaataatatcgaaaccactgtggctatcagactctcatttcagaaaaaggatatttatattggcttatctcaagaagagttcttatttacattcctgagcctattttacatttgagttctgcattcagccagactatcagagaagctgctctcgcccctcctgctgttgatcctcagtccgctgtgtactgtaacaatgccagcgagcacagggcttcctctgttcagtgaggctctgctggatgcgctaacagttctttctgcaggggctgcatgtcctgccaccctgcacccttcaggacaacacgtccttaatgtttgtttccaagctgttattcttccattctcttgagcaaatcatttctttttcgatgcttctactactcaactgtgttatcatctccctccccttgcttctgggagtgaccagtctcctggctacgtctttcattcatcaaagacatggccacacgggtcatgtcctccccttcttcccctccagactttgtaagtggcttgagcctcttggccttgtgttcaccctactcaggcaaaccatggcctggcctggctctggcattaccctgattgcccaactccaccaaagtccctgtggccacagtttcttttcactaccactttctctttgttcctcccttctgcattttcacaccgattctctgactatgtgaaatctttcatctctcaatgactccataagcctctgccttgctcccatgtgtttcttactgtattcacttctttcccttttcagcgcaaactccaagtcttactacttcaaccatacgcacgccaatacccaaatcctgtagccattgtccatctctttccctccatgtgctgaatccatattttgggatcagttcggctgtacctcttccctgcacacacttggtatgggagcgtgattggagaaaaatcacacaaacacacaggaagatattttttcagatccacagtcctgttcctcctctgggcccttgattccattcggaattcctagtcatcatttcctcccatgctcaaggggaactctccacacctataagcctccgatcattcctcttcccttatcactcccacaaatggccttacctcttcacagagaaaacggaagcgagatggaaaccattgcagctttctgtttgtaaattaacaaacagacttggcccacaccagtgctttcttgctttactcctctgaatatgcaggagatgagccttcttctaagcacaacccctctatctgctctgcattagactctcctacctccttcaggactctccctctaccaagtacttcctccaccacctccggattttcacctctccctccactcacaatgtcctgtgcacatgttagtatgttgtatgtctctgtcatcttgagaaacaaaaacaaacttttctttggcccaacattccccttccaccattggcctatctctgtcctttccttcacagccaagccaatttaaatgcatttgacagttgctctctccatctattacattcacacctccagctgactccttgatctgatgcaattttgctttggtttccagtgctccactaaaacagttattccccaaagttcccacatatcttttagatgctaatctaatgacttaatcattcactgcatggcttagccatctctgtagactggtgaccaggccttcctcagagaacaattctcttctcttggcatccatggtaccatgctctcttggttgtcttccttccgtggtgagtgtcattacctgttaccttacaggttctcttcctctgccaatccctgaaatgtcaatgttctcaagtttcccactgtaggcactctgctcgtccccttctattccaggggaatatttgcaccacaattcacctactttccaagacacaaaccaagtactatcttatcccttctgtcttctgcaccacggctggcttcacaagcatgtgacccatggagtcacacagggacaacccttgcttagaaagccctcatgcttggtttagttttgaactttcaattttttttttttagagagagagagattgacttttttattttttatccttgtgggtatctagggggtaagtatatttttgagtacgtaagatcttgtgatagaggcatgcaatgtgtaataatcacatcacgagaatgggatacccatcccctcaagcatttatcctttgtattacaaacaatccaattacactcttctagttatttttaaattcgcaattaaattattattgactatagtcaccctattatgctatcaaatcacaagccttattcattctttctatttttttgtaccctaaacttttaaattcttgaacaaggggcctcacattttcatttttgcactaagccctgcaacttacgtacctaagcttgcctacaggctatgtattcaacgtcagtctcctcctacccctctgattggccatcttcatccattgctaagatggctatagcagtgttttacctgggcccctgtttctactgttacttctttccattgtgatcccaagaaataaaataggtgcaggaaaatttaaagctatgtgtaagattagtacataaaaggcaaaacacagaatattttacatttttttaaggctagatatttggttatgagttttcttgcaaccaatgtaaaataaataactctattttccactttttcactgttatacagtatcacatcttatagacacaccaaaatatgttctctaaattatagacacttaggtgttttccaatatttgccattgcagataatgctacagtaaatgtaggtagataggtaggtaggtaggtaggcagatagacagatagatagataatctccctgtgtactatgtacacaagtttttgcaagtggaagtgctggataaaatgctttgaatagtttcaactctgcttcagagtcaaataacttgcacagtagttggaccaatttatagtcccccaagcagtgtatgaaaaacagtgtggctcatttctttgccaggtttggtattgtcagggccaatgtaatggatgcacgtggtctaccattttgctctgttttacatgtttctgattattaatgaggatgagcaactcttcacatatttatcagagtgttgggtttcctcttattatatatccatttttctattattttctactagactatatatatgtatatactagactagaatatatgtataagtgttctgtatattcttttacaactatatgtatattatataactctatatatgcattttcaattatatgtcttgcaaatacattgttctagatatttgtctttgcactttgtttatagtatctttggttgtacacaattttaagaacttattctgtaaaatttattatattaatttttttcttttaggtgtttgctttttgcgtcttaatataacaaaacaaacaaacaaaagtgaaaaaataaccttccttaatccaaggtcatagaaatagacttctacactatcatctaaatatttgaaaatttgcctttcttacttaaactttaaccatatagaattaattttataaggtcctgatgtaagctcttatttattgaatagtccattattccccaaatgattgatagtttcactagtatcacacattgtgctcacaaatttacatggcttctgatcctctccttatcaattttctatccccagaaaatattattttaattaccatttatgcttttagctttataaaaactattagatctggtaaggtgacttcatcttctctattttctccttttcctcctcttttatcttatttagaattctcttggatatttttctcttccatgtgaagcagcgtcaccttttattttcaaatgcccattactaacttgagtagaatgacactgaatctttaatctgagtacaattgacattttttgtatttgcttttcccatttagcaaaaggatgtatatctccatttattctgattttctatgtcctttttataaactttgtatagctttttcctaaaaagttcttgaacaacttacattaaatgtattcccaatatcatatagggtttttgttaatatgaatgatatctattgttttactatattatttttcttcatcttacaaaaattctctactattttccaataccaaaagttttgcatctttccaattcaaatgtcttagatctgattaaaacctctagagcaatactaagtgctagggatgattcctaaatagaatgagaatgcatctaattttttaccacaaaatagctacttttaatagacattaaagttaaaaaaaaaaactttctatccactttgctaaggattattaccataaatataaaccaaattttggaatgctttttctgcatttattgtgctgaacatattgtttgtcattcaccctactaatgtgaacaatctcaagcatatgttttctacagctatactaattttgccttcctgtgacaactttcacctgcccatgctgtattttctttaaatactactatattgctattctttcctgtgtttctggtgagtttttaaaaacatattcataaaattgatctacattttaattttccttgtctaaagttgttaatagaattgcattcgctttataaaatagattgcatttttttttttttttgctatgttctctgaataatttgccttgatgttttcttagaagttacctgtaaaaatctctagccttgtcatttggaggaatcaaaggagagactagaataaaattttatttgctttaaaagttgttggtttaagttttctttaaaaaaaaaagaaaactttttcttaagataatgcatggaagttatgtttttctacatatctcttatttcatcggtagtttcaaagttttcttgttttaaaatatctctctgctcatagttatgcctactttataattcttaccattgttcatttgttcatttcctgctactgatttcctcctgctcattctgttcataggatagtttatttattaaacctctcagagaaaagtttgagcttttctctgagggaaatatgtattaattatacgtttttataatttgtataaattttataattatataatttataattatataacttataaattatataatttattacataattataatatttataattatgtttataatatttataaatataatataatttataattttataatttatataaatatgtattaattatatattttgctaacaaagtatgacaatgttcaatatctctaaacttctgccaaaactacaaggatcttgggggagtttttttgtctgtttttcagacaagtcttattctgtcgcccaggctggattgcagtggtgcggtcaccttcagggctcactgcagcctctgcctcctgcactcatagctcacagcagccttgaactcctaggctcaaggagtcctcctaccccagcctctcaagtagctgggaccacagatgattttcttaaaagtgctcttatatattttcaaaacatctctttgtcttttggggacacattctgagtaaatgccatgggattgtctttaaggtctctaattttctatggaattagaatgtttagaatttggattgatatgcacactttttctatagatgaaaatctccatctttctcagtttgtctgtctctttctaccatacacacacatacacacacacattccatacttacctttctaaaaattgcagttgtatatatctgccccagaagccccactcctgagtcctgtcttctgaaggtccgggtctcctgctctgagttagctgttcaaatactgcatagcgatcagtcactgtggccgtccattttgttttacttcctagaagagaggctaaggcagggttccatgacttcttagacacatgggttagtataacacgtaagttagaataagtcacaaccccagccagcataacttaaactaaattaacaagtcttgatcagtccctcattatcatccatttaaccaacgtgaactgcagctatttagggacatactgtgccagaaggaccctctagcccttggccatgccacacttgccaccacatttctgttggccctttatcaagcacctcagcaggactgcatttcccccctttgactttaaggaagtcatattctattgtgggagaaagacaataaattgacagctatggaaataacaaacgtgaaaaagcaatgttagaggtacgcactgaagactagacagtgaacctagctcaggggtaagtttgaggagtgcttaatggaatggcccaatatattagccattcaacattgactacttcacttctatgcactatattaaagttgctgcttctctcacacatgagttcctcaaacgtggagaccaaggagtcatcctaactcagtctctgcctcactttttaaatcagtcattcaataaacctaacattatctcatatatatatatatatttttttttttgagttggagtctcgctctatcgcccaggctagagtacagtggcacaatcttggcacaccgcaagccctgactcccaggttcacgccattctcttgcctcagcctcctgagcagctgggattacaggcacccgccaccacgcctggctaatttttttgtatttttagtagagacgggatttcacagtgttagccaggatggtctcaatctcctgactttgtgatccacccaccttggcctcccaaagtgctggtattacaggcgtgagccaccgtgcctggccagaattttgctttttatatcccatgtaacaacttttttctgatctttattatcataaccattgcataatcccctcactagtcatcctgatttaatatttaagtaaaaattaagtcctattttttcctttttttttttgagagggagtctcactctgtcgcccaggctggagtgcagtggtgtgatctcagctcactgtaagctccgcctcccaggttcagtccattctcctgcctcagtctcccgagtagctgggactacaggtgctcaccatcacacccggctaatttttttgtatttttagtagagacggggtttcaccatgttagccaggaaagtctcgatttcctgaactcgtgatcctcccgcctcggcctcccaaagtgctgcgtttacaggcgtgagctaccgcacccagccaagtcctattttttttttaaatgctgttaaaatttattgttatccatgcataatgaatttatcttcttcaaaaaagatcaaaatgtttatgctttttattttttaaaaaataaaacaacatttagtatggggcactgttctacatgcttcaaaatatttactcatttaattttcacgtaacctatgatgcagatgtgatattgtgcttattttgcagttgagcaaactaaaacacaaaaagtgaagtaaccttctgaagtcctacagctagtatgtatccctcttgttctaaagaccaggcttttaaccacagcatttcagccactatctctagctcatacaattttgcctcttagggatattcttagggatacttaggtctgtaaagtctaattggaacacaaccagctcactcctttgcatattgtccatggctgcttgtgagctacggcagcagaactgagtcgttttgccagagaccttatggccctcaaagctaaaatatttactattctgaccctttatagaaaaaaaaacaaagttggcaattcctgctatagagtcacagttgagcccctaaaagcagtcctcttctgcaggatgttttccaggcatttgcacatgtgtttgcccctgcttgtgcgggtcgctatgtggagctgctgacacaaacagaggcacaggacactgacactcagcttccctcttatttcacataatcctgtaactaagacgtcagaattaagagggaccttggagactgcctttattctgtgactggtagtacaacgaatccagagtagaatatactcaagctagcaaaggagccaatactagaagctcttcactcttccaaacattggctcagggccaggtgcggtggctcacgcctgtaatcccagcactttggcaggccaaggcgggcggatcacgatgtcagaagatcaagaccatcctggctaacacggtgaaaccctgtctctactaaaaaaacacacacaaaaaatattagtcgggcgaggtggcgggcgcctgtagtcccagctactcgggaggctgaggcaggagaacggcgtgaacccgggaggcggagcttgcagtgagctgagatcctgccactgcactccagcctgggcgacagagcgagactccgtcaaaaaaaaaaaaagcattagctcagaagggtaagcttaaggaattatagtgcagatctaaaactgacatttaacaccttgagtttaaataaaatatctactggattaaatgcagagcctggaaatggctagttttcacatgagcatgtgagtagatgaccactcagaagcaccctgctttccatgcatttaaacagcaaactgctgcggcaggtgtgtgcttgcctgctgcctgctgcctgctgcctgctgcctgctgcctgcttggtgtgtgtatcctgtaaagatgacaaagccgtggatttcacctgcctgcagtacatctgcagattttacctgcagatcattggggctagtttacaacttcactaaactgcccccaggggactatcaaatctttaccgcaggtaagttttggaatgtaatgacaatagtttcaggcagggcacggtggctcgcgcctgtaatcccagcactttgggaggccgaggggggtggatcacgaggtcaggagatcaagaccatcctggctaacacggtgaaaccccgtctctactaaaaatacaaataattagccaggcatagtggcgggcacctgttgtcccagctactcgggaggctgaggcaggagaatggactgaacctgggaggcagagctttcagtgagccgagatcgcgccactgcactccagcctgggcgacagagcgagattccatctcaaaaaaaagaaaaaaaaaaaagtggcacaaaaaggatgataccatgaaacacaagttaccagtgcaaaactataaatgccacgtctattagcaaactacaggtctattcttcccaacgtttgatctgagtgaaagaaaccatccctgaactcataagacaaagaaccacactcaaaatgtttttaataaactttccagaggtatcttgtaatatttcattttgaattcttttgagccacgttcactctactaagatattgtcgtcctacatttctatagctcaaatttaatttcagtatcatatcacttgatttatattcattacattaatagtctgtcttcttaaatttatttgtaggtcactataaaatctgtctcatcatcttagttcctatttttggctaaagtggctcattctgaatatgttcatccttttgatcagctaatgccctttaaagttctatttaataattcaatgcatcaagcatcccttaaatttctaggatgaggaaaaatatatgttagttaaggactgcactaacttcttcatctcttcaaaaactaagacaaaattatgtgcacatacagagtgaacttatcataacataaaatgaacgctgtgctttgcattttttgctgtcgtgcataaatctgcagatttcaagaggaagtatcatggtggtaaactgaaatggcagtccccactggcatttccttttcctttgtatacacagtaggcagatgtcatgattagacctgacagcttgaatttcgaactctaaagggaaaagccaaaagacaaggagtcagtgaggtggaaaggagaaatggagctgagggaacatgggaagaggcagggcccgtgtgggatgagttggactcgttccagtaactactgtcagggtttgggtccagagaaatctggcaatgttctttctcccgtatctgatctcctattgaattgaagagatgtgaacgatagtatgtgcattgctatattaatatctcagcagtgtgtgtttgctttttgtttgttttaatgacaataattggggttacctagaatgtaagttctgggacacaagatttataccaagaggagactgaaattcggaagctatctgccacattttcacttggccctcatatgaagtgcagatagcttcagatggaatatggacacagtaaatacatatgtgtgtgtgtgtgtgtgtgtgtgtgtgtgtgtgtacctaaccctacaaacacagagagagagggagttagttttgaaagccatatattttctgaatttaaaacatttctagaattggaatacatcaagcctcaaagtttgtaaaaatttaaaaaatgcaaatcaaaactttaatgtgataccgccttactcctgcaagaatggccataataaaaaaaaaaaaaatagatgttggcatagacgtggtgattatggaacacatctacactgctggtgggaatgtaaactagtacaaccactacggaaaacagtgtggagattccttaaagaactaaaagtagattgattcagcaatcgcactagtgggtatctacccagaggaaaagaagtgactatacgaaaaacatacttctacatgcatgtttatagcagcacaattcacaattccgaaaatatggaaccagcccaaatgcccaccaatcaacaagtggataaagaaattgtggtgtatacacacacacacacacacacacacacacacacacaagaatactagtcagccatggtcaggatatagagaccagcctggctaacagggtgaagccccaactctactaaatatacaaaaaattagccaggcaaggtggcgggcgcctgtagtcccagctacttgggagactgaggcaggagaatggtgtgaactgggaggtggagctttgcagtgagccaagatcgtgccactgcactccaacctgggcaacagagcaagactcggtctcaaaagaaaaaaaaagactactactctgccataaaaaaaggaatgaattaatggcatttgcagcaacctggatggaaccggagactattattctaagtgaagtaactcaggaatagaaaaccaaacattgtgtgttctcactcataagtgggagctaagccatgaggatgcaaaggcataagagcgatactgtgtccggaactggttccttccggcaggttcctggtctctctgacttcaagaatgaagccaccccagtgagtgttacagttcttaaatatgctgtctggagtttcttccttcccatgggttcgtggtcttgctgacttcaggagcaaagcagcggaccttcgcagtgactgttacagctcttacaggtggcgcatccagagtcgtttgttcctctggtggttcacagtctcgctaacttctggagcaaagccacagcagaccttcgcagctctgaaagttagtgaggacccagagtgagcagcagccagatttatcaggaaaagcaaaataacaaagcttccacacagtcaaaggggacccaaggggtgtggggggtgggggagggggcaccttttattcccttatttggccccgcccacatcctgctgattggtccattttacagagcgctgattgggccattttacagagtgctgattggtccgttttacacagtgctgattggtgtgtttacaaacctttagctagacacacaacactaattggtgtgtttacaatcctttagccagacagaaaagttctccaagtcctggctgggtaggtggctcatgcctgtaatcccagcactttgggaggccgaggcaggtggatcacgaggtcagcaaatcgagaacatcctggctaacaccgtgaaaccccgtctctactaaaaatacaaaaaattagccggacgtggtggccggcacctgtagtcccagctactcgggaggctgaggcaggagaatggcgtgaacccgggagacggagcttacagtgagccaagatcgcaccactgcactccagcctgggtgacagagagaaactccgtcacaaaaaaaaaaaaagaaagaaaagttctccaagtccccacctgacccagcagcccagtcagcttcacctctcaatacaatggtctttggagactgggggaaagggtgggagaggggtgagggataaaagactataaattgggttcagcgtatgctgcttgggtgatgggtgcactaaaatctcacaaatcaccgctgaagaacttacttatgcaaccaaatatcacctgttccccaaaagcctatggaaataaaaatttttttaaatattaaaacaaaattacctagtaaggtatggtagaaaaaatgtaatttaaaatccacaggaaataaacaatttttaaagttgaagtgttagaaaatctttaattcaatataaatatatcgtaggatcatatgtatttattaagtagatgtcattttcagtcatttgaaaacatctgggtttatctaataggataagttaatacaataaatcagagactatacacaaccaatatattttaatcaattttaattgccaattattgcagtggaatcagtagttgcattggacactcatttcagtaaatatatttataaaaaaatacaagaatttttaaatgggcatttgtttgttagcagtgaatgttttgatatacaggtgggctatggtaaattcagacatcaggattggaatcttcagaaaccaaaagaagtgaattaaagagctctttagaagagattcctctatgctatcagcttcctattgctatgcttttctcttcctaatttatatttaggtacatgtgcaaaatattcctcgatggcaaatatctatgaaattgattagataattttaaaataaagttaatttaacccatttattattatcttcacaactctgaatgttacatacagggctggtacccagtcatttatagccaaccatttatagtcattcacagcactgaatgactacgtcagcaatgaatgtattttcacactaccagcaccaatcatccctgcaaccccaaccaacactgcaccaccagtcacaatacatcaccacaccattacagcattaccaaccataacagcatttccatactgccagaacatcacaacaccagcagaacatagccatatcatcaagacatttttaatagaaaaagggtaactgtaaaaaatatattttaagaatagaccataagaggaaacatgtatgaaaaaatatgcatttttcctgggattttaggttaagacaaatgatctattctctaagaagttgtaatagaaattatggtctgatagtttagatttagttaatactttaaaatggattaataggattgggatatgcaaaagagaagatcagcaagagagcatgtcagataattagaaaacatcattgaaagaggaaaatagattcacaagaaaggcagaatctcaccaacagtaagtattgcccatttcctagtcttatcagtctgagggcctaacataactctctttacaatccagccattgccgctaaatccagtctctcagaccacctgtcagcatgtgctacatgagtggctctttctgtatccacacgacttcctaaagtgggtcactttcattgagttattctagtatctgctgaagtattttcctcaagtttgatccagctgttgagccctaaaagatcctaagaccaagtctgttggtgatacaactaccctggagctgaatcatgtaggaaattctaggccttaatctagacattgtaagctagctttcatatccaacaagtgaatttttcagaatttgatcattgtaaatattggggtgcatcaggaattaggtgtccatgatttatgaactatatttgtcatcaggaatctgagtaaaaaatcaactaatctagggttatggctatgatactgattttaatctctaatagaaatatatttaaagaaaccaagacactatcaccaaatttgaaatcttaatatatatatgtgtatatatatattaatattcaaactgctagaaaaataaaaaataattaaaccagccaggcgcaatggctcatgcctgtaatcccagcactttgggaggccgaggtgggcagatcttttgaggtcagtaattcaagaccagcctggacaacatggtgaaatcctgtgtctgctgaaaattcaaaaaaaattagctgggtatggtggtgggcacggtgatgggcgcttgtagtcccagttacttgggggactgaggcaagagaaacccttgaaacctgggaggtggagattgcagtgagccgagatcgcaccaccgcactccagcctggatgagagtaagactctgtctcaaaaaatataataataattaaaccattaccatattgaacaaactccttgaattattctctttgaaatgctgatttcgttagaataaaaaaatactggatttgcgttttttttaaaaaaaaaggtcaccctaaattggcttttgtataagctggattatttcagacaatatgatgtaaaaagactgagataaatatcatcaacatgattccttgagtttcttcctttactgattcaaacatattcccacacccttctgttctatcatctgatgtaatatgtaaacctacagcatatgtgtaaacttgcctccaaaggatattgatgtaattttctttccagggaggaatcttagccatttactggcctggtgttggtgcacagactgacctgtttcctggagtctgatgggagtttctgttcccagtttccaaataagccagtgttgaaagtactcactgagaacacaatggctacatcatatgtgttcccttgtctgcactatcatggttttaatgtcttaacattttcccttctattcatccgcacatgcgtggctccccgcctcccgctgctagaatgtgtcaccacaaagcacaaattatgtatttcatcactattttcccagcaccaagtgcagaatcctgcacatagttagtacttgttaaacagtccgtgactcaactgaatgaatgaatggatacataggaatgacctgcacccacttccccagttgatgtattcactcatcataaaacttccatgatagcctggatgagtttcttcagttcaggaatagcaaactgctaaagccataattttataggataaggtaatgttgagaatgaatttccccacagtaaaattaagggactgtccaaattttttatattattgtacttgatttgggaatagtgcttataaatctgaaccatctacaaaaaagaaatgaaacttagaaaatagccaagtttacttggtactatcttaagattaaaagcaaaattataaataaaagtgagaattttttaatctttggtgctcagttgtaatgcttattaaaacattaaatgtcctgaacatcttacatgccggtacttttccttaattgtaaaataagattataaggacaaaataaaaccatcctctttagtcccatttctctagcagctcctacttgagctttcttgtacttgagaaataaaagaaatgatactattttagatggctcagaattgccttgaacacttagataaatgcatttgcggtgtgcagtatacattgccttggtatatttgtttatcttatatctaagactactctgtttaaatagaaaatggtcacaaagtgtttctttttatcttttaaggcagaaaaatgacatgtaagacactgccttgaaaatatgtcaatgcatcagtaaataaacactcttatctccattaccataatggagagtcaaatcggtattgacgtgcaaggtgatccgctctccgacatggaaatttttcatcaggtgtatgcttaaatttctaattgtttcctgatagagacttttttttttaaagtttttcccaaaaggtgtttagctaatccatctggctaatttcacagtgaaactgaattaattacctcttcccatctctgtcccaaacaactctatttctacaaacaaaactacctaaatgtatgctagctaactaaaaccaaaaggaaaagctgacactaaacacttaagaatgtgtccttaattctgagaaactgtcacattatggagtagcctaaggagacatgaagactaaatataatgttggatcctggaacacaaaaaagaatatttgctaaaaacaaaggaaatctgaattaactatagactttagttattaataatgcatctatattggttaattaactatgacaaatgaaccatagtaatataaaatgtaaataatggggaaaactgatggatgaataaagaaaatgtggcctatatacacaatggaatactattcagtcataaaagagaataaaatcctgtcttttggggaatggaactggagaacatcatgttaagtgaaataagcccaacacagaaagacaaatatcacctaatccacatgatctcatacttatgtggaatctaaaaaaaggaattgggccaggcgcgatggctgacacctgtaatctcagcactttgggaagccaaggttgggggatcacttgaggtcagcagttcaaaaccaacctggccaacttggtgaaacccatttctactaaaaatacaaaaattaaccaggtgtggtggcacacatctttaatcccagcttctcggaaggctgaggcagaatggcttgagcctgggaggcagaggctgccatgagccaagactgaggcactgcactccagcctgggtgacagagcaagactccatctaaaaataaataaataaataaataaataaataaacagttgatctcagggaagcagagagtagaaccataactaccaaaaactccagcaactggggagaggaacagggaggagaggatgtagagaggtagggtgactatgattaaccataaggtattatatgttacagaatagctagaagagaagattttgaatgttcttataacaaagaaatgatagataattgcatgtggttatggtcacactaaatacccagatttaatcattatacaacatgtttatcaaaacatcaaattgtaccccataagtaggtataatcacattgtgtcagtaaaaataataatagggaaaacagtgtgaggtatatgggaactctctgcgctaccttcataacttttctgtaaatataaatctatcctaaaataaggagtggattaaaaatgctttctcttgttaattgaataatttttactcagaaatattttcagtatcttagaattaatatgaagatttgtatgcaatctcatcaaataagagatagagctgaaactttgacaaaaatatgtcctacatttaattttgtaaaattgtgtattttcctaagcttattttcatgtgactaatgaagcatctaggtaaaaatgagttgacaaaatttaccaaagttttaaaacattactagctattaaagtagttaatgatcaaatttaagaattatacaaaatagtctcttccagtggaccctgtactgtggaaatagctcattttggagattgctccattatatccaatagttgacaatggagggcaatcaccatgttacaggtaaaagggaatgtcatagcttcacaaagtcagcgatggtccagggactgctttttagaacgcaatgtcctgataactgaataattacagcaatcagaaatgacaaaagaagttctgagccttctatctatgattcatttggaaaatgattcatttccaaatctttctctcatgtattaataaatatctaccagagctgtggatgaagaggaaaatggaattcatgatatgagttgttaatattttaccatcataaaattcaaagaaattaggagtctgcaattttcctttatttcaagaagtatgttttctatatcaccaaacggaattgtgtatgcataaacacaggccacaaggaacagaggttcatcagatctgttgagaaagctaccaagcagaagaataaatcagaaacagtggtgctcatgcccttataccacagagtcgtttatcatgtatggattgcttggatttattctaccttgcaggacggagtaggaatgtgttaaatcttccttgtgcttagatttgtgaaaagtagctttgaagattccttaagaaagcaaaatctgtacttaattcaatgcattagcacctattattaatcctgaaatggatctttttcctttgtgataaatctgagataacagtaggttcatgtcggcattctctgtcatgtggctggctccttgaaaagatttataacaaacaggctgcgtctggggaaagggttacttttaaaaatccagcgggataaatgcgagcttcacagcgccacctctgcctgactgcctgtttgcgaatggaggaaatcctgacatagatttcaacacaccttatgattaccagagcacagacgggtcagcacgttggggcgaggggggagcgcctgaaggtgagatatttccagtagaggcctatgtacagatggcaagagggactaaatattctggacctgttgcatatgggcgctcccgctgatgcaaaacggcgttctgaacagggaaggcatgcgtgctgcgcagcagggctcccgcagcggggtgtgggttcagggtgctggacttcaaaaccgcctgaaacgcagtccaaacaggaacatgaagccctctcaggagggagtgccctttttcctcaaccatttttaataaaatattttaaatgatttttcttcattttaccatatttacgaggaattgtggcatccccacatctatttatagcacttacacgtgtctaaaccagaacagggtctatacctgaagagctgacgcctccttcagatgcgcgttccgtgggtcgaatccacgccagtctgtgacaaaaagtgctcttgcaaagaccaaaatgttaaaaggatattggaaagccacgtggggttttgaaagaacaggaaaaagaaacagagctttgccaggccctggtagagaaagcctccattagaaagagcttcatttcaatgaaccttctcaggcaaggtgacaccggtttgggtgattggctggtgactccgccaagcattctgcagtggagtaatgactgggctccgcgcccccacagccccttcgctggacctgtcctgagtggctccttgggcaaatcgcagtttacttccccgtagggagagaaactcaggcatccaggtgttagactgtgggggtcctgcaccttcttccttcaacccctgggcgcacagcttgaagccctcctgggccggacgacgtgggaaatgactgcaccccggaggccaggagctcgcgctcacctcccaatgacttcaaaatgtgtggctgcatcttgaggaagagcagatcctgcctggtgtccgctatcggcgcggtggctgacaccgaggcaggcggcgctctccctggccatgatgaagccgccctgtgacccccacagcccgcacttctgagcagccgcgactccaggcctcactctgtgtcagctacttcaggagaggagaattacgaatgaggtactaatgaggaatttcatcacctgtttaccttcaccgatcagtggccctcctttaatttaccagaaacacattctttttaggctgctgtcagctggaatggcctcttatttgaagtggttataaagtaacacatacctgggaaacttgcctctgtgcatgccttgggctctgataccacagtctacaggaagagacagggagccaaacacaaccagggtttcccaagcagagaggagaggttaaatacctgcgattgcacccagtagtatgttttactttttaacaaggaccaccaataatgttaatccatcagagacaaattctcataatttagaattaatactgaaacaagagggcttataccctatgtggagctatttctttttggaatccatacctaggaaggtggtaggagcacacacaggcagcaagaaagaaagatcaaaggaactgggttcagatcccaactctgtgtgacgtccgtaatcacttcccctacttcatctttaatttccttacctgcaagatgaaaatgaaaatgcctttcccattggatcgtgggaaaaataatgacacaaagttacaaaacagttttttacactgtctggcaccggtagatgatcataaaggccgctttctttttcattttaacagctacatagattcaatccaatttatttcaaatcaacagatacatgttgcagaaaataggaaaacattattaaataactataacaaccaagtagccataagatagaaataacaagcaacttctttaagaattttatttcctatttaagctttaaatttatttttccattcttcattttcacataaaatattatttagaaaattgaattcatgaagatagaaagtagaatgatggatactagaggctaggaagggcggaaaaaaacagataaagggaactcgttaatgggtacaaaaatacagttagaaggaataagatctggtgttcattagcacaatagggcaactatatagttaacaataatttattgtatatttcaaaataactaaaacagcagtattggaatgttactaacacaaagaaatgataaatgcttcaggcgatgggtaccccaattatcctgatttaatcattacacattgtatgcttgtaacaaaacatgtaccacataaatacgtacaaccaatatgtatgcataattaaaaggaaaaaattaaaaagaaaaaagattatgtcctactctccacaacaatctagtttactgaattctagtttctaattctaatgtaattcacctttgacaaaatttcagtggcttacaatgacctactatgtagaatctaaactctacctggaactctacctggttggtgtggctgcctgcatttactaactgtattagtagacactcaagttacaagtgacagaaactcaattcaaaccagcttaaactaagtagagaatatatgggcttccttaactaagaagggagaaaatctgccttgggcatggtgagattcagaaacgcaaatgatttcctcaggaatctttctcttctccatctctggactctgctttcagatattttggcttcatttttaggtgggcttcctccttcatttcaataaaacttctcaggtaatgtagggagcaagttgcccaattggagttctaggattacaacatcgcttaagctaacaaatctagagagaagatattatctttttccaggaaattctagcaaaatatttacgaaggttgtttttggtccagtcagatcatgtttgaaccaattgctgagaccagggtgacagagaactttgataaaccaaactaggattacatggccatgtctatggctaaaagggaaggaggtcaagcatatcaaacacataacatgggcttgtttggattttaccaaaaaaacatgttcagttacaagaataattataacaaaagtgtactaactattgggcgcatagaccaccatacctctcttcctgtcaaatctagtcaagtccttaggctgacccagttgtttactcattcttacttgaatacaacttctcatggataggacaaggtggttcttggctatagtatgaccagactctccttgatactctcctgtaattttcattttcacatttttccagatccctgatcttcttcctggtttctaaattctcatgccgttttacactgttaatcttgcacctctctgatcaatgcctaatttgaaatattaagccagttcctgactgaccttatcctcgccaccctactggcctcaatttctcccatctggcctgatttctaagaaacccacatatgctttgcaaaaaatgctccacttcatatttcttaccaatgtgttgtaggaacctaccaagctggaaataatatgcagagataaacgtgtttaaagacagactattctccaaaatagtctcatttttttgcctaacttattatgtattttctgtcacttttaataaattagtctaaattaatatacttttcattttctagccccgttaatgtattcatgattttctaaagaatcccactatcggactttcagattatgtaaagggaaactgtagactttcaagtcatttaaagggtaccatgataaaatgaaaaattgtatggatttagatttagaagtcataggtttcaaccctagcacttctaaccagatgacctcttgcaaatcacgtcatcttagaaaatcaatgtatcaataaaatggaacaccatccttagcagtttgtagtgagactaagattagatattgcccgtctgccaattgcaaatatttttcaaatgtgtttccatttttatactatttactatttagactttctattatggtccagttttgctccttcaaccaaattagatattatttgacagaaaatattgtaatttattactgtttacttctagaatagctttaagaacataccagatgctcagtaagtatttatttcatgcttggctctgaaatataattgaaggataaatatttggcagttgtgatcctttaaatttaaatgataaccccactatcaaaataatctaacttaaagtcaaattatatcacttaggtaaactggaatagatgcccaaaaagagccagtgattctcatttttttttcaaaagaggagaaagataagaaaaaggaggggctattgaactgagaataattgccattatatatcattataaaattgggactcaagaaggtgaaagacctttataatgaaaactacaaaacaccgattaaagatattgaagaaaacacaaacaaatggaaagatgtcccatgctcatagattggaagaattaatcttgttcaaatgatcatactacccaaagcgatctacagattcaaagcaatccatttcaaaataccaacgttgttctttacaaaagtagaaaaaaaaattctaaaatttgtatggtaccacaaaagactttgaatagccaaagcaatcctgactgaaaaactaaaaatctggaggcatcacactatttgacttcaaaatatactacaaaattataataacagaaacagcatggttttgggatagaccaatggaacagaatagataacccaggaataaatccacatatttacagccaactggtttttgacaaagggcaaagaatgtgcaatggggaaagggcgccctcttcagtaaatgatgctaggaagactggataaccgtatgcagaaaaattaaactggacccctatctctcaccataagaaatcaactcaaaatgaattaaaaatttaaatgtagggccgcaaactaaaatactactagaagaaaaagaatagggcaaatgcttcaggacattggtgtaggcaaagattttatgttcaagacttcaaaagcacatgcaacaaaattaaatatagacaaataagactacattacactaaaaagcttctgcacagcaaaggaaacaataaatagagtgaagatgcaacctatagaatcaaagaaaatactttaaaattattcatctgaaaaagcctactatccagaatatacagggaactcaactcaacagcaagaagaaaaataatccaattaagaagtgagcaaaggatctgaatagacatctgttaaaataagacattccaatgccagtaggtgtattaaaaattctcaacatcaataatcatcagggaaataaaaatcacaaccaccatgagatattatctcacccagttaggacggctattatcaaaaagacagaagataacaaatgccgctgaggatgtggataaaaggaaactcttatagctgttagtgcgaatgtaaattagtacaatcttgtgtatttatccaaaggaagggaaatcagtatatcaaagggatacctgtacctccatgtttattgcagcattggtcacaatagccaagatatggaatcaacctaagtttccatcaatgaatgactggataaagaaaatgtggcatatattcacaatggaatactattcagccataaaaaatgaaattcatttgcaccaacatggatggagctggaggttattatgttaagtaggacactcctgtgggagataaatatcttgatctcatgtaggtacagagtagaatgatggtcattagaggctgggaaggatgggagtggaaggaatgaggagagattggttaatgggtacaaatatacaattagaaagaataaattctactgtttgacagcacagtaggataactatagttaataataatttattgtatatttcaaaatagcagaagggaagaatttaaatattccccaaacaaataattgataaatgtttgaggtaacaagtatcttaaacaccctgatttgatcattacacattctgtgcatgtaacaaaatgtcacatatacctcaccaatatttttaattgttgtgtcaatgaaagaaattattccagaaagtaggaaaagaagaaaagctgcttaactccttattccaaaatcaggtaaagacagtacaagaaaagagaatcataaaccctgtgttgctaataaatatgtgtgatgtgtggtatatctctgtgtgggtaggtgtgtgtatctctgtgtgtatttaaaatttccttccaagtgttaaatagacatcattttggggtgggagattacaaaaataaaaatagaactaccatataatctagtgcaactactggatatatatccaaaggaaatggaatcagtacattgaagagatatcttcactctcatgtttattgaagcactattcacaatagccgagatatagaatcaacctaagtgtccatcaaggaatgaatagatttttaaaatgtggtatctacacacaatggaatactattcatccataaaacagaatgaaatcctatcatttgcaacaacatgaatgaacctggaggacattattaatatgagatgtcagacacaaaacgacagataacctcatgctctcactcatatgtggaatctaaaaaagttgatattatagaagtagaatagaggtagttaccagagactgtgagggtagggtgggtgggggatggggagaggttggtcaataattacaaagctacaactagaaaggaagaataagttctggtgttctattgcacagtaaggttaccatagtaaataatacacttttgtatatttcaaaatacctgggagagaagatattgaatgctgtcaccacaaagaaacgatacaagtttaaggtgataactatgctaattattctggtttgatcactacaatgtatgcatgtattgaaacatcatactgcattccataaatacgtatattatatataaactaaaaacaaaattaaacttttagaaaaacagtacatattttcatacactagaaaactagattctttactaatagactgtactggttgaatccagattcctaaattgggctcctgagtttgaaccacatcccagggctgtaacataaatcacgtaatctctccatccctccttttcttcctggcaaaatgctaataataatagaatcaatcacatagagttgttgtgatgattaaatgttgaaacaatcctaacaagtttagaacagtgaccaacacatggtaatattcaataactgttgtggttttcattactgtggtagggatttttacagaacgaggttagcagtctgctcttgaaaacagaataccctagaatttaagagtaatttcaatccattcaagctgcttgatatagtttgggtatttgtccctgcccaaatctcatgctgaaacatcatccccagtgttgaaggtgggtcctggtgggaggtgtttgggtcagagaggaggatccctccaggcttgttgctgtccttgtgatagtgagtgagttctcagaagatatggttgtttaagcgtgtggcgcctctgccacttgctcctgcttctgcctctgccatgtgacgtgcctgctcctgcttcacctactactgagagtaaaagctccctgaggcctcctcagaagtcgagcagatgctagtgccatgttcctgtacaacctgcagagccaggagccaattaaacctcttttctttataaatcatccagtttcaggtatttctttgtagcaacgcaagaatggcctaatacactgctcatttatcaggtcaactcagcctcaacttcattccttcctttatcaaccagccccggtgatgcctcccacctctggcatgttaagattctcaccggtttacatggagttacttccctgataagcccattgtaagtagaaaaaccttaagtagaaccatagtaaagttgaggatatcggttattttctcattggaactcatttcattagtagcttccattcagttttgtcattgctatctattgccctacactttttacaaccttagccctgtatactgaccactgaaattccaaacctttggtgctgctgcatcatcacaggccaaacaaattagaagattatttactaaacttaacagaactataagataaatatgaggccgggcgcagtggctcacgcctgtaaccccagaactttgggaggccgaggagggtggatcacgacgtcaggagatcgagaccatcctggctaacacggtgaaaccccgtctctactaaatacacaaaaaattacccgggcatagtggcgggcgcctgtattcccagctactcgagaggctgaggcaggagaatggcgtgaacccgggaggcggagcttgcagtgccgagatcgcgccactgcactggcctgggcgacaaggcgagactctgtctcaaaaaaaaaaaaaaaaaaaaaaaaaaaaaaaaaaaaaaaaaaaaaaaaaagataaatatgaactgttaacgtattaggaaatttttcatgaaagcaaaataaaataaaacaaagtaaaaaatactttcatatttatgatcacaagtttctactaacggaaggctccattttatagacagtccaactagtgatcttatttgtttactaatcaatccaccttcatctatcaacctatcaatctttaaaactatttattattttctgctagtccccgtctattgtatacaaccctttttagaggattatctattgcgtgtactagcaaagtcccatattatctttacacaaatgtagactattcccactgcttatcaagcttaaccagagtttgaggagaattgaggagaattacaaaaaagattcaattagttttttgttgttgttgttgtttttgttttttgttttttgttttttttttttaccagttgttagcatttctagtaaaaagacttgggtgtagtagaatactgaagctagggctaaaataaaatttaggacctctctgtagatttcatttaattctattactacttctgaaatgggaaaattcccttgtcccccttgcagggcatgcgatgggggtgtggctcacttcttcagcgccccactgctcaaacctttaggggagcatacagaggggcaggctgtggggctccaactccaggcagtgtctagggctgaatgtttacagccgaagctccagtgggcatgtgttacagtgtgctttcagttttgccgcctataggcagtttgtgtgagtcagctcaactggatccctgccttattgcaactacagagggctttctgtatcccgaggttcttgccccagaagaatcggatcacacgtgggcttggagaatgagtacaaggttttatcgagtggaagtagcagatggcagaagacagaacggaatggagtgggaaggttttcccctagagtcgggccgtttagtggcccgggctctcctctgccccagccaaactgcaggttgttctgcttctgcccgtcggtggcctggtgtgccagcatgccggtgcctgtcgctgtgttcctctaggcatccagccgcccgtgcgctcctctgcctatctgctcctctctaggcccagcagcttgtgtgtctgcctgctagggttgtggccggggcaggggtggtggggtggttataggcgtggcagtccagggtgatcttgggaaatgcaacaaaaatgcctgtcctcacccagtggtggagccctcgccggggaccatccttcctctacccagcacttccgttccccacttccatatcatttaaagggaccagctcttcccttcccagcacttcccttccatatcacttccatcaccaacatgggcagttaggtgttaatcggagaatctgaatcacaaagaatgacttctaaataaaagagcctttaaaaactctcatctgatgttttggttgaaagatgctaaaaatacaataaaataaaaactaagctcattcaagagaaatattaaaatatcctccagccagcaaaagtactccttaaaatattacgccaataacacaacttttaattttattttaaaaatatgtttcttctatgagttaatgtgatattttaaaaagataactgtaaatatcaaatggccctgcagctccctttccatgtatttatgcttagtggtgattcagagaccttgctgtgataatcattttcaacttaatcttagactcaacagagaaatactccctgaagaaataagtacagattgtagtttgaaaaggaaatgacatttcaacttttttatttactcattcttgtttcactttaatatagtgtcatgcaaatataatttcccctaagtcaagtaaaatagaagcattaatttggtttccactcttgtatctatattttctgtgtgcatatgtagaggtatgaatttctaaagagagaaaatattttttcttttttctaaacatgtgtcattatatatatatatatatatatatatttttttttttttttttttttttttttttgagacagagtcttgctctgttgcccaggctggagtgcagtggcacaatctcagctcaccgcaacctccgcctcctgggttcatgccattctcctgcctcagccccctccccgagtagctgggactacaggggcccgccaccacacccggctaattttttgtatttttagtagagatggggtttcaccgtgttagccaggatggtctcaatctcctgactcgtgatccgccagtcttggcctcccaaagtgctgggattacaggcatgaaccacctcacccggccacctatgtccaatattctatactgtgggacagaattacattacgaaaccttccaaaagttgttaaaacccattatgtgctaatagaaaaaataattttcttgtgtttgcagttattcatgtgatgaatctaacttcatgagcattatatttagaattcagtatgaatttctaccctatcagctgtagcgtggattctctgaaagacaatggagattaaacaattttactgtacagaactgcatgctggctcatggtctcaattttgaagttaaatgaaatgaaaagtgtagatttttttttttttttgagacagaattttgctcttgttgcccaggctggagtacactggctcaatcttggctcaccgcaacctctgcctcctgggttcaagtgattctcctccctcagccttctgagtagctggcattacaggcatgcaccaccatgccaggctaattttgtatttttaatagagatggggttttccatattggtcagactggtctcgaactcccaacctcaagtgatctgcctgcctcagcctcccaaagtgctggattgcaactatttcctgaaatccattactttcataaagaaatctactcttaacaccaagcctgtgcctgaccaaacaccactgtcccaatacatcagtgatatatttactccccactaattatttccttgagattttttgaattattaacttttctacagaataaagaaacataattatgaagacaaatgttataattcactatgttgagaaatagtttaacatgaattatactttaagcccatggatgaaagtttgttcttggtaattttctttcaacacaatgacttttaccccattcttaagcaatttaaacacctaacaggattgcaaacactttctgtcatcttcactaggccattggttaatttctgaaagtctacagaaaaataaatttaaaaagcaatgcacttctaattataagatgtgagttctgccaggttcacccctatgccccacaaaaattaacttttggtggtttcagatttctcatccccaacactgcctcacctaaatggagctggatttgatgtgtaattgacaacttttcaacacctacaatttttgacatattctaatccatattggtagctctatttttaagtatattttctgctgaaaatactattgccactaataatacatgtctacctttttattaatcaatagtagatgcatgtccagttacctagctatttagggtttcttgtgagaatgaaataataattattgtcaactgttactgatgatacatgtctacctttttgttaatcaatagtagatgcatgtctagttacttagctatttagggtttcctgtgagaatgaaacaatcattgttgtcattcttaattgatgtaactttagccaaaagaaaaaagtcttaatatttcaagtagtctgaactgcatcagcaccaacgtagcttagatcccttttctcaattttatattgggaaccatttcaccagatgatctcagatactttccctcacaaccatttgataaagcatcattcaatcactcacaagcaagttgaaaaagcatcgtgatgtctttaaagtataatcctgccatgtcaactttaaaaatgaaacatatttaggctataccatcagctgtagcaagcagggatcctatgcagattttcaggtacttctcccatccaatgggttcactgcagtattgctgtattgaatttccacatgaggagccagcaatctacactgaaggagaatgtacctgtctactggcacaacgcagcaagagccctatgtatggaacaccttcaggccacaccctgaggaacagacaaagttatatgcagttcagtatccgtcttcttacaaactatttgatagaacaagatatagccacatttcataaaccgaataatacagcataacaaattgtccgggacaattaattatatagtgactgctatgacttctgaagagtctcgggaaagcttcatggataagtctgactcaaatcaacaagaaggatggttgtgatttagattggctgaagcaaggaggccaccattccagaccagaaatctctttccaaagagcaaaatcaaactaatttttaggggcagaaaacatgttttcttgcttgaactagtgtattctgaaggagcgacagctaaagatatttacattagaaagaaacaactaattagtgatgatcctgtgtgatatggtttggctgtgttcctacccaaatctcatcttgaattgtagttcccataatccccacatgtagtgggtagggcccagtggaacgtaattgaatcatgggggcagttaccctcatgctgttctcttgatagtgattgaattctcactagagttgattgttttataaggggattttaccccttggcttggcatttctctctcctgctgccttgtaagaaggacatgttgcttccccttccaccatgattgtaagtttcctgaggccttcccagcaatgtggagctgtgagtcaattaaatctttttcctttataaatcacccagtctcgagtatttcttcatagcagcgtgagaacagaccaatacactgtgttactcagattatatgcaaaagttcattgaaaaaaagaaaacatttgcacagatcattagtttgagaaaaggtgattctttccctttcgcacttaccaggaagataaaaggaaggagctgatgagcacataagaaaggagttgtgagtacaaggatttttatcacagagaccagcagtaaagcagtttcctgagaatggcccaagagaagcacggaaggaaatttatattaaaattctggtgtatttcccagatgtttcccacgtctagacagttagtgaacagagatgaatatctttagtcttacttaatgtagcaaaaatctcccctttttaaaatgtctgcctagacttccaaagtgggtgtgacttagaactgatagtcaaagtatgactcaaacaataggaagctaatgtgaatttatctaatttttgtgttctgttttcataaggagagctgatagtttccttggtatcaagaccttttttaaaaggaaaaaaaataagaaaatggaaaacaacaaaaacaaaaaaaaaacagttgatctgattctgtggcctgaccaaaatacctagtgtcaaatgcttttgtaaaaaaaaattcaactttcttggaattgttttgtgacattaagatagtgttagttcccatatcctatctctcatatgaagcttcattgaattccagcataggaagagactcaagaattcagctactcctacctttcactgcagaagctatgatggagcccagggagtatttttaatgagccaacaacctcatcctaatgccaaaaagctctctgtagttattttgaaaatgcaagatggtcatcatctcatcagagaaggaatgtataggtacagattaataaatacacgaatgaaaaaaatccatgccactttctcagtgtggtaaagaattttcatgaccactgatgaatacaatactttactttgatttattgtagctaaaaagaaatttttttaagaaaaattgtttctgagaaaggcagagttgaattagtttgagaagaatttgagcctgaggaaagaagcattatcactgctgcatccttggcagcctagcagagaattctggtaactcttacacttaaatttccattctgggactgagaacctgctttcttacaggttttgcttaggaagtacagcacatctgatgacttctgcttagagattgtcacatcttgaaaaatatttccttcatatagagtgcataggactctagactttaaaatatccacgtttgatatagacatgttaattaactttagcactgtactaagtgactctctagtgtccggagtactacatggagcacgcatacttctgagtcaagtgattattaaagccaatcaaagatgcccatttatgtagtatgagctgcattatttttcaatttaaatatggtgttgtcatagaaaagtcaacatgaacaaatgtgagaggaaaatcagtgtgataattccaaccttcgaaatactggaagagtagacagtgttgccttagacatgattggattctttacatctgtcactgtcccctctaactgagttccagcttcatggtctcaagaggcttgagttcatttttttaacagaaatatctctccccaaatcacttacatcacaggaacatttaaaaaatagaagagaacacaaaaaaagctcctaagtggtagttactgaagctacacacaaaaaagcatagggccttatttccaaatttacactaagtaattatcttacttcattttctcattatatgattttaagaaatccatgatagaaatgtaatatgaaaatacaaccaaagtctttaatactaattcctatagtgttaaaatactgtgagcacggaagaaaaaatcaacaaaactagggtagtagcatcgtcctagaaattctttaaataattgaataagtaaaaacgtattgctaggtaaaaacatcttatatccagcccattgatgatattaggtcctcagtaattgttgaattgcaaattcgtaagactactgttatttttttttattttttttttttttttttttgagcagagtattgctctgtcgccctggctggagtcagtggtgcaatctcggctcactgcaagctctgcttcccgggttcacgccattctcctgcctcagcctcccaagtagctgagactacaggcgcccgccaccacgcccggctaattttttgtatttttagtagagacggggtttcactgtgttggccaggatggtctcgatctgctgactttgtgatccgcccgcctcggcctcccaaagttctgggattacaggcgtgagccaccgcgcctagcctattgtttgtttgcggtttttttgtttgtttgtttgtttgtttgtttgttttttaaattctaaagctctggtattttttctggttttgtcaacagtcactcgaaggttcttttgacctttgccaggagaatttcctttacttctgttctgatttcgattctgtttccctggtcctgtgcctttctctctcttttggatcacttttcactttagggtaagacatattccagagttccctgagagacggtacttggcaggtcaattttctgagaattcacatatctgaaaatgtctttattatactcattattttgactccctccactctgccaccctcttttccccactccctctccccaccctatttttaccatccatctacccaaaaacattttcccccaccttcgttttcccaccctcttctccccactgccttctcccacctccctcttgccaccgtctttgccccagactttctccccattcctcctggccaccctcattcccccctcccaccgaccacttcttcttgccaccgtttctccctctatctatccaaaaacgtatccactgtcttcttcctgctccctcttttcctctctccagctgccaccctcttcccgcctcactccctttccccaccctcttttccccctctttctacccaaatgcatttttcccctccatcttctccctgctccctctcgccctcttttctgcctccatctacccaaaaacttttttccctactgtctttacctcactgtctttttcccacaggctattccctcctcccattctccactctcttccccactgccctattttccctccttcccctctctaccctcttgctgaccctccctctggcgaccctccctctcgccaccctcttttcccccctccaactacccaaaaacctttttcccaccctcttttcccctacccctcttgccaccttcttttcctccctctggctcgccaccttatttttctcctccaataaatgaaaaacttttcccccaagtcatttcccccaacatcttttccccactcacgccaccgcctcttccgcctccatctacccaaaagctcttttccccactgccttctccctcagtcctgctcaccgccctctcctccccgctcccgcttgccaccctctcctactgtacttattcttgatttatggctggctaggtataaaattctaaatattctcagccttccaaaggtttcactcaattgtcttttaggtatctgcactgctattgagaaatccacagccattctggcaattcactcttcaggtgatctgtttttctacttgttgacacttttagattttttagactgcctctaagatcccaagatacccccccccctttttttttttttgagatgcggtctcactctgccacccaggttggagtgcagtgctgccatctcggctcactgcaagttccgcctcccaggttcacggcattctcctgcctcagcctccctagtagctgagactacaggcgccgccaccacgcctggctaatttttttgtattttttagtagagacggagtttcaccatattagccaggatggtctcgatctcctgacctcgtgatccgcccacctcagccctcccaaagttctgggattacaggcatgagccaccatgcccggccttgaattttgtactaagtagttgttcaaccttaggtgaatcatttaacttctttgggcctcactatcacaaaactactgcattaggaatgatttctttttttttcttttttgtttttgggggagatggagtttctctcttgttgcccaagctggagtgcagtggagctctctgcaaactctgcctcccgggttcaagcgactctcctacctcagccaatttagtagctgggattacaggcgcaccaccacacctgggtaattttttgtatttttcagtagaaacagggtttcaccatattatccaggctgatctcgaactcctgacctcaggtgatctgcccaccttggcctcccaaagtgctgagattacaggtgtgagccaccacacctggctggaatgatatctttagactaggattttcttcttctcacctgttaccttaagagcctgctgaactcctattacttttttagacccagctgaaatgtcatcttttctgtgactcttcattcatattgatatggcttggagatctgtcccctccaatctcatgttgaaatgtgatccctagaaatgaaggtggggcggtgtttgggtcatggggcagactcctcatgagtggcttggtgccctactatggtaatgagagagctctcactcccttagtgacacatgagctgattgtttaaacgagcctgggaccttcttccctgtctcttgctacctctctcaccatgtgatgcactgcttcccccttcaccttccagcatgattagaagcttcctgagccctcaccagcagcagatgctggtgccatgcttcctgtacagcctgcagaaccataagccaaaataaacctcttttctttataaattacccggtctcaggtatttctttaaaacaatgcaaacagacaaacacacatatattcaagattatggttttgtgtttttttgttttttgttttagatggagtcttgctctgtcacccaggctggagtgcagtggtgcaatctcggctcaccgcaacctctgcctcccaggttcaagcaattctctgcctcagcctcccgtgtagctgggattacaggcccctgccaccatacctggctaatttttgtatttttagtagagacgaagtttcaccatcttggccaggctggtcttgaactcctgacctcatgatccacccacctcagcctcccaaagtgctgggattataggtgtgagccacagtgcctggcctcaagattatgttttaagtatcaggtacttgaacccattcctagtcagaattatcaaaatcttcttttattctcatgtagtatgcttttatgagtcgattaaaacactctttgttttgtattataattgtgtttttacatgcctctcttcatcccttgactttgagcttatcctttaaagcctcaatgtaactgctaggtaatttatgctcattagttgcctggtaaacatttgtgcaatgtaatgacctacacgttctttaaattgtttttcagctcaaaaataaattgtattgtttaaattgtacatgttgtaaaccaaacctatcctctttcttcccaaatccgtttctcctattgttaatggcattcacagtcttacttactcagggctcaaaattaaatgtacctgcatgtggtgtggctaagagaatagaatttgagtcagacagataagaacttgaagcctagctcttccacttgactcaatataggatttgggcacattattaatctctttaagactcagttttttcatctgcaagaaggagattaaaatatatgcagcccaaggtttttgtggaccttaaataaatcttgtgttttgaatgtgtagttgacactttacaaatgtttcctcttatctcctactgcactcattctaacattcctggtagcacggtcacagcaaactttttagaaagagtaattttctctctaacttttattgatttgcaattaagctacctgatgccctttatccccaacacatgacatgcctggaaaattcaatgtgagctaattcctattggagacatatagtctctatttaatacacaagtacaatatgttgaactacactttatagcttaaattagtttgtaattaagtgataatatttaattggatatggccctttttaaaaaccatatgttttatctatagagaaatatgtatctggtttatatttttagatgttttggaaaaactccaatatgctcttgcctactgtattttaaatgcatttaaacatgttttactgcttttgactctcaatatattagccaatgatattatcaataaacttttttaaacaaactttttttacttttcattttaaatcagaagtctgcagacagctgataatctagcatctgtgccttctgtctttatgtccaacacaaactcactttcatactccacatcatgttctttaaatttatttggatcctaaatggatattttcctgtgacagctcttctgttctggtctgcaataatattttaattttcagtgttaattaattgtgttattttgtgtttttaaaactagattataagtgctatgtatgaaataaaatttttttattgttttcattttcatacaataaaatatggtataattctgcccattccagatgtttcattattttcttataactctatcaatgtagtataaatcacaatttaaaaagctgatcaaatcaacatgtgctttgtcccatacaccaactgaacaaatatttcttgatttcaaatgatgaacatgctgattttagagtaatactgtttatttcctttgaaaaaaagttaatgagtgaaatatacatataatattctctaagtgtctaaaccctgagtagatatatttatattaaatatatagttaaagtatatataaatatatatactttataaaatatatttttatatttaatataaaatattttatatttatatgatatttatctatttaatatgaaatatagctatagactttataatataaaatataaagtatatatataaatatatatatacttaaagcacctgatatgcttctatgccctaaaaatgccatacttttacaaataccagtcatgcacctcataacaatatttcagtcaacagtgcaggtctcataagatcataatgaagataaaacattcctatcacctagtgacaatgaaggattcatagtgttgtagtgcaacatgcatcactcatgtgtgcatgatgatgtagtgtgaacaaagctatatacagttttgtgcagaacagaatacgatagcaatagtaaatggttatgttgttggtttatcagttgactacactgtacttttaatcattattttagagtgtaatcctcatacttattttaaaaaagagttcactgtaaaacagtctcaggtccttcaggaggaattccagaagaaggcattgttattacaggagatgatggctccgtgtgtgttgttgcccctgaagaccttccagtgggtcaagatatggaggtggaagatggtgatgttgatgagcctgaccctgtgtaggcttaggcaaatgtatgtgtctgatttttactttctaatgaaaaattttaaaagtaaaaaattaagaaaacatttttaaaatagaaaaaagcttataaaataaggatataaagaaagaaaatgtctttacagctgtacaatgtatttgtattttaagctgtcagcacaaaagagtaaaaaagttaaaaaaattcaaagttcataaagtaaaaaagttacagtaagctaaggttaatttattattgaagaaagaaaaaattaaagtttggcatcgtttcagtgtatggtgtttctaaaatctacagtagtgtccagtaatatcctaggccttcatattcacttactactcactcactgactcacccagagcaactcccagccacgcaaggtctgttcactgtaagtgccctgtacaggtgtaccatttttaatcttttatgcatatttttacgtaccttcactatgatcagatacgtttagatacacacatgcttaccattgtgttacagtttcctacggtattcagtaatttgtatacagtatacagtaatgtgctgtacaggtttgtagcctaggagcaataggctataccatatagcctaggtgtgtaggaagctataccatccaggtttgtgtgagtaccctttatgattttcccacaataaaaacatcacttaacaattcgtttctcagaatgtactcccatcatcaagggacacttgactgcatctgtatagcaactgaggttgtaacacggacaacatgtcccataattcaccttctttgggaaacattacctctcattgaaaaatcattatggctattatttagttttgcaactccttaacaactaggaagctaataagactgggtacaagaatttcaaatagaaatactaaagcaaatagttaagtttcacaggaaatatatcagacttaacgtggtaataagcattataaaaaataaaatctcacacagagcaaccatcaaaataataaaacctttaggagtcaatctttgtccaccagctccaccatatggcattatgagaatttacaccttatattcaagggaaaaaaacttcccaaatattaaaaaaacactaaaagttccatggcaaaaaataatttaaagtgataagaaacacgtaacactttatcaataatgagtgtgcatttctttacctcatttatgtttcagagtttctaagaatatggtattttttccacgggaaagcatatattaaggtaagctaacctttcattttaaacctaaacacattcagaatgctttgcaatcttattttgccttacaatgttatttttccaatgttgaattggagttcatggttctctttgttttatccaataaaatgttatccaataatatttatgcaatagtctagatatctactatattttatgtaatagttcatatgtccatgcaaattgaatcatttcaaaaatatagaatgatgtatgaaaaattatggctaacacttagaaatctacgaagcctctataaaattaaacagtttcctcactttaactttctactttcctttcctacccacaactttggtcagtttcttaaattggagcatacaagtatattaaaaaaaaaaaaaattccacaaagctattgttgtgaatagcaaaacccaaagctaaccagcgtgagcataagaaggagaggctttgtgaggaatttatgcacaactggaggaggagttgaataacaaagctgggaaggggagtggtaggcctgtgttctcgggtacctggtttccgtgctgcagtccagatgtgagtcctagggtcttctgggtcaatcaggtgtcatctgtagaagctgtagttggacttgcttaaactcaggggccagggcagtgttagtcacatacgttcaccaacatcaaagacaatgtgcaaactactaagtgtcaactacatctagttggtgtagatctagacaaagcaaaagacaggtctagaaggtagtggtgctagttgtggtagagtatcactttcaatcctagctgtaaagattcgttactaaagtgatccaaatgtaaattgtgttattaaccagataattgaacatttctagccccacagatttaggtcaaacatgatatttatcgattttagatgcaaattgtgtactgtaaggacaattataaatttctcaatatgaatgtggtcttctttcttgcggaagtaactagctaaactaaatgaaggcatagatcataaagcacgtcacctcccactaggtgttaaagtagatgagaagaaatctgagaatatttcggatgaaaagacttttttacagcaggaaataaaggtattagctgttgccatgagtaagtcggtgggtaacagtggatcactatggccatgagagtaaaatcatttgcagacagaggaccaatatacatctgtgggaagtggtaaattccaaggatgtacaggtaatacattggcatgtgtgcccttcttaagtcttttttatatcctgacatcaatttctcagtaacaaagtaattagacctatcctttattgagcattaattccatgtcagtcctgtatctgctttacatgcagttacatatttaaggttcacaacaaccctgtgaggtattattattgtatctttttcttacagactaggaaaccaagacatggaagagttaagtaatctactcaagatcacacatctaagaatgatttaatcagccgggtgcagtggctcacccctgtcatcccagcactttgggaggccgaggcgggcggatcatgaggtcaggagatcgagaccatcctggccaacatggcgaaaactcatctctactaaaacaaaattagccaggtgtggtggtgggcccctgtagtcccagctactcgggaggctgaggcaggagaatggcatgaacccgggaggcagagcttgcagtgagccaagatcgggccactgcactccagcctgggcaacagagcaaaactctgtcccaaaaaaaaaaaaaaaaaaggaaagatttcaaatcacaatccaactttacaacttaaaaaattagcaaaagaacaaactaaatccaaagctagcagaaggaaggaaataattaatatcagagcagagataaatgaaatagagaatagaaaaaaaatcagtgaaactaaaaaggtctttgaaaagataaaattaacaagcctttagctaaatgaactaagaaaaaaagaaagaagacaaattactaaattcagaaagggaagtggggacattattactaattctacataaataaaaattgcattttttggcagggcgcggtggctcatgcctgtaatcccagcactttgggaggccgaaagtggggatcacgaggttatgagatcgagacaatcctggccaacatggtgaaaccccatgtctactaaaaaatggtagtggtggcgggcgcctgtagtcctagctacttgggaggctgagcctggagaattgcttgaactggggaggcagaggttgcaatgagccgagatcatgccactgcactccagcgtggcgacagagcaagactccgtctcaaaaaaaaaaaaaatgcattttgtgccctaaaaatcaacagtctgaaaattaaattacaggaacaatttcttttacagtagcttcaaaaataataaaatactgaggaattaatttaaccaaggaggtgaaagattaagtgtacaataaaaactaaaaaacattgctataagaaattgagtaagataaataaatgtgtttcccatggaaatggactagattacttagtattgttaagatgtcagcactacccaaagcaatctacagactcaatgcaatttctttcaagagtcctaaaattgatatgaaatctcaagggaccttgactactcaaaacaatcctgaaaaagaacaaggctggaggactcacactttctgatctcaacatttacttcaaagctacagtaatcaaaataatgtgatactggcataaaaacaaaccttatagaccaaaggaatacaatagaaagcacaaaaataaaccacctcatatatggtaaagtgattttggtaagggtcacaaggtcattcaatggggaaaaggcaatattttcaacaaatggtactggaaaaactggacatccaagtgcaaaagaatgatgttgaacccatacctaataccatatataaaaattgcgtcaaaatggatcaaaagcctaagtgttaagacctaaaattataaaactcttagtagaaagcataaggcaaaagctgcatgacattggatttggcaatgatttcttgatatgacaccaaaggcacaggagacaagaaaagaaatagacaaataagactgcataaaaatgtaaaaattgtgtgcatcaagaaacactatcaacagagtaaaaatgcactctacagaatgggagaaaatatttacaaatcatatacttgagaaggtgttagtatgtagaatatgtagagaacttctaaaactcaacaataacaagcttgattaaaaaatgagcaagggcttgagtaaaacacttgtccaaagaagatataaaaatggccaatatgcacgtgaaaagatactcaacatcaccaatcaccactaatcattaggaaaatgaaatcaaaactatgctgagataccatttcacacacattaggatgactactataaaaaaaaaacagaagatagtaagtgttggggaagatgtggagaaattggaactcttgtgcacagttggcgggaatgtaaaatgatacgaccatagtggaaaacagtatgggtgttcctcaaataattaaaaacagaattatcaaatgactcaacaattctagttatatacacagaaggattgaaaatggggtcttaaatagatacttatacacccatgtttatagtagtattattcacaatagctaaaatgtggaagcaatccaagtgcccattgacaaatgaaagaataagcaaaacctggtctttacagacaaccgagtcttattcggactcagaaaggacggaagttctgacataagctacaacgtggatgaatccagaggacattatgctaagtgaaataagctattcacaaaaagacaaatattgtaaggattttacttatatgaggtactcagagtagtcaaaatcataaaggcaaagtagaatggtggtttcctgggcctgaggggaagggacatgcagcgttattacttaatgaatatagagtttcagttttacaagatgaaaagagctatgaatatggatggtggtgttggttgtgcaatattattaatgtatttaatagcactgaactctgcacttaaaaatggttaagatggtaactcttatgtgtatttttaacacactaaaaagttggaaaaaattttggaaaatttgaaaaaaaaattaaagcacatataaggtttatcctgagagataaattttgctttccccaaacttacctaaaaatataaacagtgtagagaatcaattgcagtataattcaaattgaagaggtaagttctaaatacatactccatgccttgttctgtgtcaagtactagatatatgaagataaatatttctgacatgcaagaatgtcaatctactatagaacttatagcacttgttacagaatctagactaaagaattacacagagacactgtttattgtttggacaattaattttgtaatagtaaaagcaatcctacattgagcacctattataagtcagttagttttcctatgttatctcatctttccaacaatactgtcagattgagatgatcattcccgctttacaggtgtggaaagtgggacttcaacagttagttagcaagtctcaagtcccaaattaggttgtggtggagctggctttccaacccatttttttgttagttttttttttttgttttgtgtttttttgttttttgttttttgtttttaagacagagtcttgctctgtcgcccaggctgaagtgcagtggcacgatctcggctcaccacaagctccgcctcccgggttcacgccattctcctgcctcagcctcccgagtagctgggactacaggggcccgccagcacgcccggctaatttgtttgtatttttagtagaatggggtttcacggtgttatccaggatggtctcgagctcctgacctcgtgatccacccgcctcggcctcctaaagtgctgggattacaggcatgagccaccgcgcccggccagttttggtttaattttaacacttatgcctttctcatgacaccaaatgacatccctagaaaattaattaaatttcacctgcttagtctcatctccccaaatacacagtgagctatagattactgtcacattcccatgaaatgcatcctcacagggagggcaattatcactgggtaccatggctgactcatctgcaatattttggggtggacaacctttacatcacccaaatcacagcacagagaggttacttgctctgaaaatgcttggctatcttgctaaagatttgtctaagcagtcagtaataatctctgcggaattacaaagcaatttcttctgatgtttccatcagagacttctctctgtcaacattctacgccattaaatcacaagcaaggataatggtaccagatttcactttggttgtaagtagaataataaatggtctccttaaatgggtgagaactatgtgtgtacgtgtgtgtgtgtgtgtgtgtgtgtgtgtgtgtgtgtttcaaagaaatctttcagtgtgtttattctttgaaaagaattcttggtacttcttgccaaggctttggggtttctatcttgaacaaaagtaacttgactttcacacgggtttgcaggaggtctgagcacttaattacagtccattatccgctttcattatctttcctcctgcctgaatgagctcaacaatttccagacattactactttcatacaatttttcattttctctaatgtcatcattttatcaccaagtttttgatctttacagttcatctaagttttatactttcagagaggcacttcattgtaaaagcaccttaatttttttccagcttaaaatttaactcttgctttaccttatatttccttttcatcaaagtatttgatttcttttaaaaacatattaaaatataattccttgaaactaattagaaaatgtctccttgtacccaacctaatttggatatactaaaaatgtgaacattgtgctaactcattttcctctttttggacaataataaatattccataggagaaaatgttgtatagatatcaaagaggtgtctataaatactcttcccagacactaacatcgactcctgtctagacagattcattttaaactagttttgaagccatctaactctactaatatgcattccttccagagtcctccaacctattataaaatcattcaactcagtgattctccaggaaggtgaccttaacccaccagagtcttgatatctactcgggttgttatcttatctgagaattacacttaaatttggttgagatgaccttttttaaacaaagttgattggcttatacttagtatgttatggtattcaggcactaattcaccatttcccctagaatgttttgaagtatttgccctgatatgttaagcagcattgtatttttatttaaagaggattctagcatcccttccttgccaattcttcagaataacaggttattaatatttggagatagtgtgttcccatagagggatgccaaaaatgttaatagagaactatgaaaatatgcatacgtaggtgtgtgtacacacacaagtgtaaaaaaagaggaataaagaaagaacatgagactacaactcactacaacacaagctatacatttcaaatagcagactacaacaatacactaacactgtgcacaacaaagaaagtaaaatttatgggaagttcccccttacatttgcaaatgattgttgcgatattaaagaaaacttttaagctgcagaaagcaaattatactgcatttcaaattgtaatatttaattgctgaaacatttgagcctcagagataatctgcaccaaagagaatccgtgcccttttcatgaagagaattgagcagaattcacctaatctatacagatatagaatatatacctttttattttttaattttttatcttttattattttttcttttgagacagaatctgtctttgtcacccaggctagagtgcagtggcgccatctcagctcactgcaacctccccctcccaggttcaagagattctcccgcctcagcctcccaagtagctgggattacaggtgcctgccaccatgcccagctaatttttgtatttctagtagagacggggtttctccatattggccaggctggtctcaaactcctggcctcaggtgacccacctgcctcggcctccctaattgctgtgattacaggcatgagccactgagcccagccagaatatatacctttttattttaattatttgtggatcatgctgtgtgcctcacacacaacacatgcactgtcccctccccaggtttcacacatcattgttgctgctactggcttctgtcatattctctcaggacaaagcatagcagaaactcataaaggtggtttccaagagctgacttaaacacaaaattcaaggaacaaacaattacccaccagacttattttattattttactttcaagaaacacagacacttcttagaactttataacatattgcctgcatcacaatttacatgcatttaggcaaaactgacaacatatttgttcatctgcgctaaaatgttttcttcaaactcttctgaatcctcctaatcagcctagtcaaggcctgtctagaatacactgcaaagcagctggtgtctgcagcatctttttatctgccccacaccctgcttttagaagcaagctttactttcccttcaccagtccaatttccatagcaggctcctccagatgtacttctggctcactcctgacccatcctggcccaggcaattcactgattctgtttaatccaccaaggtcttgtgcaataattcgacaaaatcagataaacagtgttacaatcagaaatgaacagtcccaatgcccgaatttattctctttctgagatatctccagatttctttcccctctcaacattatttctttgttttcttgtttctttgttttgtcttgatttgttttgtttactaaatctatcctagatgaaatgtgatttttcacattttgtgaatgtcatcaaagctaactatgtacacttaccctcccctaatttggatataatttaaaatgaaatctgactaaattgggttaagcttggaaaaaataaaaaatcattaaaattattaaagaattatagtcaacatattagtatccagagatagcaactattacatttggaatagtaattttgtgatttttctctatttattcatacctacataagcatgtaggtagtttatgatatattgtttaaccataaaattgataattttcacaattaatggaatagataattatgcatgataaaataaagagaaaaggatagaaactgtatttgataagatgccaattatctatacatatgtcataactatataaatgtctgtatatttctgttgtgcacagaaaattgcatatatatgtataatgtacaaaagttttatctgagtgctttacatattatatcatgagcgttttcctaattcatcaagcagttcttttttttttttttttttttgagacagagtttcactcttgttgcccctgctggagtgcaatggcgcgatcttggctcaccgcaacatccacctcctgggttcaagtgattctcctgactcagcctcccaagtagctggaattacaggcatacaccaccacatccatctaattttgtatttttagtagacacggggtttctcctgttggtcaggctggtctcaaactcccaacctcaggtgatctgcccgcctcggcctcccaaagtgctgggattacaggcacgagccaccaaagtagttcttaatgttgtataatatatcatgttttggatgtactaccagttaattgttcatgcctttaaaaaaacttgtatgcttctaaatgttaataccattatatctttcattgacattgccattcttgaacttggattctagacaaaatctgccattatttccttgaattctgagacatgaaattattgggctgaaaactgaaaacagtaaaatattttaacacacactgccaatgtgtttccctagaaaggtttgatccaattatcaatgattgtaactgcatactccactgaccataacttagttatattttgtttcttatttcctagattaaaacatttcatgcatgtagtttgcattctgtttattacaaatcagttgcatattattagattttgtgttgatctgccatttgtagggaatttgtggattggtcttagttcatttttattggtgcttttgcttagggactttttgtcatttataaaaacctatcataatattacagtaattaatactttagctggcatttacattgtaaattattttcttagctctaacaattttgatcttttgacttaagtgtattaaatgtaacattgataattttctctgaaatctcaattgttttcaacacgttatgatttagtgttttagtctgcatgtttttgttttggtatatgatatgagatacgaacaaaaatggaatatagagtttctccaaatactctagataatgataagatcttcccaataccactaatcaaaaaatccattacccccattggtttgatatgttatctttatcacatacacacacacatatgcatgtatgcacacatagacaaacacacctagaaagataggcagctgctgctttctccagttcttccatctgctgaagctagcaacagaaccacaatgtttagaaggaaatagcattgtctatctgctatggccaaactacccgcattcttattcttctttattctctgcattcattctaacttgtttctaaaagatcttttataacttgtattaagccctcacttggcaccctcaccaaaccttatttctttcattccatggcctataattttattaaaaccaaaaattaattggggaagaatgtgcacctgtaacatagtttattactccctcaaaagatcacagcacatttccttatttgttaaaattcacttttaagtttcctagtatgttttcttcatatatgcctaatgcaattttctctaggaagattcctagcagcagcgttttgaattttatttatttttctttttatttctagtttttagttggtatcataattcaaatattttctcatccctatatcatcaagcattatggataatatatgagaacattttatttgtatgttaacattcatttactttattgaatactcatttatttctaatttcttttctgattctcttacatttattgtttatgcaaatttcagtaatgcaaagttgtccactgagcaataacttttgtctcctttttctatttcatgtcttatttattgcattgaccaaaatgtcgacaacagtgttgacaggtcatgtgttacatttgtgaatatgtagatcaatggaaattctgatgatatctcactgttaagtgtgcctatgctgttttttgagatagatttcattaaaacagtttcctctttgtcctattttctggtgcatatttattttgaaattaacaatgggtatagtatgctaacatgccattcctagtataacctctttggtcatagtggctaacttttctaatttattattatatttaatttctgatatcttaattagtttttaataaactattttatgggtaggcaatagagtatggctttgtactcaaaagatttctattccagttctgaaatgtaatagtgacatgaccgtgataaatgttatttaaaccatatgaccctcagtctcttgatctgtaaaatgggactaatattatctagttcattagattgcttaactcagtgtctgacacaaaccacaaataagtaaaaataattactgtcagtggttggaattatagtttcttacataatactgatgaatagaaaagttagatatatccatacctttttcagaaagcgatatattcatttggattttagatttcttatggcacatacttataaatgatttagaaaattttatttgatttcttaagtttttaaaatgaatcattctgcacactaaattatatacatgggaatgatgtgcttattaaatttggggaactacgtctctggatcctgaccttggaaattttagtagcgataaatcttcagaaactttcttcagttttttattgatttcttaaaaatggccagttcaaaaaacaaatcttcattgttttagtatagactaataatatgtacatttatgaaattaatttgtatctagacaattatatatagttgccattgaatttgcatttgtctaccttgaatgttccagcagcttgcctactttgtttttgaagttctttctttgttaaaagggaagcaaaacattcttgcatttcctcacatattttattagggttttttttctaagttacttatttcccattgtggtatttattatattcttccatctaatattcttggttttatttcaagttttcttatctgactgaatgaatgtttcagtcatatttttttcatatataaagcaagacatttaaaagtatgaattttcctgaggatggcttgtctaagtttcatatcttgttgcaagaagccatttctcacatcatttcaaaagtctataattttaattttattttccttttttgacccaacatatacttggttttgtttcttttgagtttttaaatagtttggtgtaaaatttcatattaatttttatgaatttttatcattgtggtcagaaaataaaactttataatttttgagtcatggaatttattttcagcttcttaactcttttctaatgtgaacggctgtgttatttgtgaagattcaaagttatgcgtgttttagtcacaatttcctgtgctataaagcatcctcccctgcttgaattctgaatttaccaaagcaagaggcctgagttctagtttttttcttttgtacatccagccagtaagccgcttaaccactctgggtctgattcaccttgaccatacttaatcggtctgggccttagtcttaaacctgaacaaagaaatgatcattctaactcagagagcttccttaagacatcatcagtgtaggaaaaagtagaaccaaaacttagttctcctttatgcaacgagtaaggtgttgcttttatctttcaagcaaactttttaactttaaatcaactttactggtgtattatttacattatcagtgcacccatttggccgggcgccgtggctcacgcctgtaatccctgcactttgggaggccgaggtgggcagatcacgagatcaggagattgagactatcctggctaacacggtgaaaccccgtctctactaaaaatacaaaaaaattagccaggcgtggtggcgggcgcctgtagtcccaactactcgggaggctgaggcatgagaatggcgtgaacccgggaggcggagcttgcagtgagccgagatcgcgccagtgcactccagcctgggcgacagagcgagactccgtttcaaaaaaaaaaaatgcacccatttaaagtttgatgtttttttacaaacgaatacacctgtgtatctaccaccccaaacaagatagagaatacttccatcaccccaaaaagttctcttgtgaccctcaccaagaaatccatttcctggacagacactgacttctaatttgtttccactggcagaaaaagcaaatgggagcagagatatcaccagatgagacatcaccaaaaccatggaacactaacatccaactaacaagggacaacagacagagcggtggaggaagtttagacctaacttcatctaggagtgaaaaacgaagccagagtaatgaagaggcaaagcatggaagacttcggggcagtaaaactcttctacatgataccataatggtgcacatgtcattaagacgcaggatcccttccatgctgcttcgctggccagaaatctccacagccagaggcgcctataccgggcttcgccggggcctctggaccactgggctcgctctgcccacgcggccaagcaggcaacgcttggctgctgctactgggcctggatcccaagcctgccgccgctctgtgctcagcccgcagttggcccggacatgccgcaccagcttccaccttgagtgccggggtctgaacaaggaggacgcagcggcacctgaaaacggagatgctagcaactggcgagccccaaggggtgttacatcttttgctcagggagtctcgaggtctgagcccgcaggaagtgttacagctctctcacgttcttgccacccacagctcagcgaatggggtgtgtcacagctcctttggtcccactgcccacagttcgctgaatgggggcatgtggcacccagcagttttttcactcccgtagctcagccagcaggaaaatgttacaactcttttcacacccaccgtttggcaggttccagattcttgtcccatgaccaacaggaatgaggtatggagacagcagagagtaagcaagacaaagaagaattttattgactgacagaagagctctggacaacaagaggggaccaaagttgttagttctccgagtgagagggggcctgaaagtgggtagccatgtgtgaggctctgtctagggtttctctggactcagaatgggggagtgtttgctgatttgtccatgggcagggcgagtaaaaccaccattcaattggctaaaaagcattgaggacgtttttactctggtcattgactctatgcgtaggtatatcatatgtgtctttgggatggtagctaagaggatgaagaaaataaggaaacttaccatctacaaataagtaattaaaaaatagtaatttaagtctactattgttttttaattcttattatcattattgctttacagacagggtctcgctctgttgccctggctagaatgcagtggtgcaatcaaggcttactgcagcctcaaccacctgggctcaagtaatcctcctgtttcagcctcccgagtagctgggaccacaggcacacatcaccctgccctgctaactctgttttttgtagaggcagggtctcactatgcttcccaggctggtcttgtactcttggcctcaagcaatcctccctccttggcctcccaaagtgcagggattacaggtgtgaaccagcaagcccagtcaagcatagtatttaaaacataaaaataaagtcgctataaagctgaaagtgattgcatgtgaggaatgggacatgggaaaggcaggagcagcactgttgctttaagtttagtttttaatatgtacagatactattttgataaaaactttaaaggtaattaaattacatagaataaaaagaattaacaatgcattatcatgagcctttaccacctgtgtttgacttaacctacaatcacattctggtatcttcctaaggacaagaataatgcttctttcatgtttatatctgccaagtctatcatagtgccttccatctagaaggtgttcaataaatacattgaatttaatatgtcaaactggttaatatgaaatgagccttcttttcacaaaaagaaaaaggatttaaaatgcagaacattaaagccgtattaaaaatatcatgaatggggtatatggcaagagagtatgttctgaagccagaccttgtttaaagtccctctctgctacatattatttgtgagatgttgtggaatattcttaaacctctaacattacaatgttctcatttttaaatggtgattatcccagttcacttgttggtttgttgtgaaaattaaaggaaattacatgtatcacagtttgtggcttttgcataatgtatattaagtaaatgacaatttcccttttcagaacattgataagtggcataaaggcttcaatgaaaaaaaaaatcatgagcttatatttcttgatggaaaggaactagggaataaactgtgtggtgtaacataaaaaaaaatacactagaaagtcagggctaaggctataaaagtaatacgtgccaatccacagaaacagacacataaatatttccaccagttctgcaaaatctccggttctgaagttgatagaattttggactttaattggagaggttaatactgggacaatatctctctctatgcctttaccaaagccagaacttctctcagatccccttgcacggtcaaaatcagcccaatcaaagacagaaataaataagaaacaaaataaccagaataggaactcagatttttttttaaatcaagattggttcttacaaagttgcgtttctctgcctcaaacgtttgtctgtgtactttgtacctccacattgacctctccagtctcagagcagttgcaagcttcaaagagagccttatacatgaaggaaacacatagttctgctgtccgaattaaaaaaacaacattccttaaagatgtctcctatcaattacaactcaagtgttgattacaaagagaaacaatttcccattcaagaccacttaaatccggtttagtgtaatatattcatttaatctaggttaactctgcaaaggtctttaccatggcgtgctggcatcccctctgccaacccccgccctcaaactctgaaaggaacatataggatattggacaatacacaatggaacaagtggagagacagaaacaaatggctgttgtgatgagaaagccaagagattcttgatgcaggctaagggtccaggaaaaaggcagccaacagtatatgccaacaagaaagccttgtctcctcagaaaactgtactttatttatgaggggggaaaatcaaaagcattgtagaaattgctctaatttcccataacacaaatgttataaaaccaagaatagctgaatgaaatggcagctggtacagcagacaagtctagattgatgaagtctagtcatggtcaacagttaattaaattcaacatacagtttttatcatcctcacactttgactttctgacatttacattccccattctcttgttagggagtttcttcttggctgaaatttctgaataataataatcttccatttagctgaaaggggcaataaatgggtactttgatcatctttagctaagacaggaaaggaaagcatcaggaagccctcttgtctttccagtgtgactgtattcacattcttcctagtcagttatgagcagttataatgacctgtggctgatcattagagaaattgacattttcacaggtgtgtgggtaaggagagagctggggaggaatggtgaggtgaaaaaagtgagaaagtaaggtgggaagtggcagcactttcctgtcaaatccttgacctatatacatttcttttttgggactgaatgagtatagataactacctgttttgaaagtttcacaaaagagtatatgttcttttttgaaggtgagacaatctttgtataggactaaatataggagcacacatgcaatggcatgatggcatatattttattcatgtgcaagttaaaaaaaagaatgcttcataggtcaaaaaatattttccatatatgaccttcatacccctaaaataattttatgattatatacacaggttatttcttctttgaggtaattgtgaggataattcatcttatcaaattaatataaattattatgactaatttggatataacatgagcccagagaatctccaaaataaaagtaaatttctgggaaaatgcaaaggaaatacttttcatcaattctatgtttttaatgctggacccaatacaagttatgacttgacttgagaatttaatgacatggtcatagctacctctacatttagccaaaaataaatgtttcaaactagttcaggttgatctcctggacaggaaaattgcaattcccaccctagttggttgtagaaggagaacgtgccagaacctccaccaggaagggtagggacgggccagtagcccccacacactcttgaacatagacttcacatgagtgggactgcatgggaggtccctcagcaatgtcgaaactgtactgacttaaaatatctctcctctccacaaacagaaacagaggaaacaaacaaccctggccacctggatgctttgcacatcatttcatgtgtgagcatgcatgtttttaagcttctattattttatatgttttccccattgttcatgcttctaacgcattcgacaattattgagtaattctaggctcccaggaggctacagtgagcaaaaagtagcaattccctgcccgatgaagcttctagtgatgggaaggcagacaatatcaaataaataaatatgtaaaaatgtaagtagatacaagtgataaaaattaagttagagtgaggaggaagacagtgtgtggtgcggtagtggatgttttatttagaatgactgaagaggtctctctgaaaaggggatgagctatgtgatgctggaagaggcagccctgaggtgaggccagcgaataggagccctggcaggatgtgagagggagcgtggacagtccgtgcggtgaggacagaggagtaactgccgccacacagagagcctcgcctcttgtcctgagccagatgactgcgggcgattgagcagagatgtggcataatttactccatcttagtaggatcactctgacaattagaaggtcactgcatacatccagatgaaagtgggggaccatgtggaagtcacaggtgatgagaaatatgcagatttttaaatatatattttgaaggaagaattcatgagatttgctaatggactcaagttgaagggtgagaggaaaaggtatccagggaagttgtagcttgagaaactacaggtctcagtggccacttataaaaacagaagagattgtggaagacacaagtggctgccccttggatatacaaatagagatgttaagaaggcagttagatacacaggctggagtccagggagaagcctgggctaacaaggcacatttaggaatcagcagcttctagagagtagattaaatgccataagataaaaggaaatcacgggacagtaggtgcaggccaagaagagaaggagttcgaggctggagccccaaggtatgcctgattctgcaatgggagacacagaggaaccagaaaggaatctacaaggggctgccagtcaggaggaagaaccgagagtcagtgatatcccagaaggtgactgaacaaggcgctgaaggaagagtgaggaacagagtgaaacaaaggctcggaatggaccgtgggactgattgaccctgtcgttcaattatacaaaacatctaagagtatttctatttcctgtgtacgtgaaaaaggaaaaaaaaatgtatcatgaggaaaaacaaagaaaaagaacttcttagtgtagttaagccagtattccaatccagctgcctgctggactccaggtagacatggcaaagaaatgtcacttccttaggccattctctcacatcccaagtgacatcagccactggaaatgataattttctttgctgtgaagagacacatggcgtctccccaaggcctctggcttatttcccatgagcctctcagcagcctccacacaggaaaggctcccattaggcaaggtcgcttggtgaggccacacatgactgcctccattgtctgtcacaacgctgagacatcgcgcttcggaaaaacaacttagtgttctgtcaccccaaagaacggaaataatagagagcgtcagtttgtatgaagcacaccaaaccaaccaaataaacaaaacaaacacacacatcacttggtctgcacacgcttaaattactgagaactctgtaattaattttcctcattgtgaatgcattaatggcgtgctttcaaatctgtgacataaaacttagaaacagaaaaggcaaaagaaacgaacctgtgacataaaacgtagaaaaacaaaaggcaaaagaaagcaagatgtgacaaaaccactgcatgagttctgcttttgtgaagtggctttctaattcgatggcctcggctcatgagctagaatataccagaatcaccagcagagcttctgcttcaccacttcggggaagcctgtaaagaatgagacttaaaatacatgcaagttcacagatgctcatttaaatccatagacactaccattttgtagttgttttttaagcctaaagaaattctggcaaaggtcttctggtatctgttaaatagaaaagcagttctaagtccatgtgacttttgtactatcttctacacaatctcactttctattccacccaggagcataacccataaagcaagcacaatgctgcatgtagaaacccacatttccctaatgcattgaatcaagatcaacagctgggtgagcccacgtttggaagaagttgatgagggtgcagattgctaccgtgcccccttaattgagcaatgaggctcccttttggccccaacctgaataatctggttcctccaaaattttaataagggaagcccatgctgaatatctcacagcaggttttcctgtttccttccattttaaataaacaatagactactggaaacagaatgactacagtgctttttaatatcaagtgtatttaacaaggagccaacatggtgaggggaaatatccaaagaaagatttctttttccttattattactattttttttttgagatggagttttgctcttgtcacccaggctggagtgcaatggtgcgatctcagatcactgaaacttccgcctcctgggttcaagcgattctcctgccttggcatcccgagtagctgggattacaggcacctggcaccacgcttggctaattttgtatttttaatagacacagggtttcaccatgttggtcatgccggtgttgaactcctgacctcaagtgatccacccacttcggcctcccaaagtgctgggatcacaggcatgagccaccatgcccagcccgtcagaaaggtttcatctggaaaatagatgtgctcgtgtggctttctgctcatcttaacattgatgtgcatgtctgcctcaccgctgattttttccttgagcccgaccatgaatgcagagaaggtaaatttaagggactcaaaccccgcctttggttgccagatcaaagatatgagcagttcctctgggaccatgatgtgggaaggtccagagagcttatgcgcattcctatagaaatcaatgattctgagtctggatgcagagctctctattcagagttaactgaattaaaccctaagatgactgaaagccatctaaactgttaatgcctattgctactttaaggaatactgctttaagtgaagaaataagagcttacatttggctaaatacctcaagatctccagcctggtgtgtgtgtgtgtgtgcgtgcaagtgtgtatgtgtctaaaaggggacatgttcacaactagattggaaagaggagagttcactttaaaccaacaaagggcctctagtagtttcatattgagaaaatgtttttataaatgtgcttttgccttgagcaaacccttgcatgtaagccacatatacacattagaatatttgctgtagaatgaaagggcacaattattttccagaaattgtatcatggccatactgtctgcagactctggtataatttcaatctctgcctccactttcacttggccttctccttgggaagcttcatgtcttcttataatgacacttaccataggatgtaaaacccatcaggataatccagaataagctcatctcaagatctgtaattccatctgcaaagacccttttcccagattatacccccaaaaaaccattttcctgccacgtatgccatttacattagcaccaaaaaaaaaaaaaacgcttaggtataatcttaaaaaacacacataaaagctatataaggaaaactgcaaaactgtggtaataaaaatcaaagatccaaataaatcaagagattccatgttcatggataggaagacaatattgttaagatgtccattctttccacatttataaactgagcacaatcacaatcaaaatctcagccagttattttgtaaatactgacaaagtgattttaaagtttatgtggaaagacaaaagacccagcatattcaaaacaacactgaaggagaagagcaaagcataaggactgacctactgaaaacttaccataaagctacagcaaccgggacaatgtgatattagaaaagaataaacaaataagataatggaacaagagaaagagcacagaaagagatccacacagatgtagtcagcttacctttgacaaaaaccaaagacaatgcaatggagaaaggacagactttataacagatggtgctggaacaactacacatccacatgcaaaaaagaaaaacagaatctaggcataaacattacgcttttcacaaaatttaattcaaaatgagtcatagacctagatgtaaaatgcaataattgtgaaacttgtggaaaataacataggagagaatctagttgaccttggttttggcagtgtttttagataccacaccaaaagcacaatccatgaaagaagaagttattaaatcaggtttcaatcaacttaaagactcctgctgtgccaaagacacttagtagaacaaaatgacaagtcacagatttgtagaacatttttgcaaaacacatctttaataaaagacaggtatctgaaacttacagcctgaacaatgagagaacagataacccaatttttaaattgggcaaaagatctggacagatagtttgacaaagaagatatacagatgacaaacaagcatatgataagtgacatggtttggctgtgtccccactcaaacctcatcttgaattgtagttcccataatctccacgtgttgtgggagggacctggtgggaggtaattgaagcattggggcagttaccctcatgctgttttcatgctagtgagttctcatgagatctgatggttttatatggagcttctcccctcttcgcactgcacttctccttgctgccaccatgtgaaggacgtgtttgcttcctcttccaccatgattgtaagtttcctgaggcctccccagccatggtgaactgtgagtgaattaaacctctttgctttgtaaattacctagtctcgggtatgtctttattagcagtgtgagaatggactaatagaataagatatgaatcatatacccttagggcagagtaaattaaaataactttgatgtactactacttacctattagaatgactaaaattccaagcattgacaacaccaaatcctagtgaggttgtggagcaacaggaactctcagtcattgctggtggaaatgcaaactaatactgccaccttagaagacagcttagcagttgtatgatttttttccaaaactaaacatactcttaccattcagtccagaaattatgcccccttggtattgacctgaatgagtagaaaatttatgcccacataaaaacttgcatacacatgtttacagcagctttattcataattcccaagcttacaaggaaccaaggtgtccttctgtaggtgaatagataaacaaatggtagtacattcagacaatgcagtactattcagtccttaaaagaaattggctattaagccatgagaagacatagaggaatagtaaattcataggcttaagtttaaaaaaaaaagggctctgtaaaggctacataccgtatgtcatacctacatccaattatctgtcattctggaagaggcaagactatggagatattaagaagattagtagtaccaaaggatttcaaatagaaaggggacagggaataggtagggcatacaggatttcgagcagtgaaactatcctgtatgttacttatagggtgggttcatgtcctatacacttgtaaaaactcatagaatgtacaacacaaagtatgaaccctgatgtaaacttcggactataaaataatgtatcaacattatcttatcaattgtatcaaaaggaccacactaattaaaataataatgaggaaattgtgtgtgtgtgtgtgtgtgtgtgtgtgtgtgtatgtgagagagagagagaaagagaaagaggtggggaaaggggggtgtataataactctctatactttctacttaattttctgtaaacctaaaactgattttaaaaaataaactctattttaaaaaaattcaaataaatgatttgaatagacctttctgaatttctgaaagaaagataaacagccaatatggatatgaagaaaagctcaacatctaacatctttagacattagggaaatgtaaatcaaaatcaaatgagatacgactttcatacccaataaaatgactataataaaaaagacaatgacaagtaatgatgggatgtggagaaataactgaaatcctcatatgttgccagtgagaatataagatgatgcagtcattttggaaatagtttggtagtttatcaaactgtgaaatatgtaattaccatatgactcagcaattcttaggcacatacccaaaacaaacgaaaacatttccacatgaaaatgtatacacactcggctgggcgtggtggctcacgcctgcaatcccagcactttgggaggccgaagcgggtgaatcacgaggtcaggagatcgagaccatcctggctaacatggtgaaactctgtctctactaaaaaaatacaaacaaattagccggatgtggtgatgggcgcctgtagtcccagctactcgggaggctgaggcaggagaatggcgtgaatccgggaggcggagcttgcagtgagcagagatcactctagtgtgcactccaacctgagcgacaaagcgagactctgtctcaaaaaaagaaaagaaaagaaaagaaaatgtatacacactcagctgcattattcatattggccccaaagtggaaataatccaattattcatcaactgatgaatggatacacaaatgtggcagatccattcaatggaatatattcggccatgagcaatgaagtagtactaacatatggcacgacatggatgaaccttgaaaactttattagactaggtgagaaaagccagacacaaagaccatagagtatataattccatttacttaaaatgtccaacatagggagatccatagacatagagagtagattagtggttgcctagggctggactgagagataaggtgtggagtaattgctaatgagtacatagacacagggttgctttttgaggggtcatgaaatattctaaaattacgctatagagatagatgtacaactctgaatatactaaaacccactgaattatacactgaattaaaactttaaaaagtcgtttgcatttatttagtgcattacatattagattttgcactcttatttatgtttttccatttgagcctctcaataaaatttgatattaattttttttttttttttgagacggagtctccctctgtcgcccaggctggggtgcagtaacaccatctccgctcaatgcaagctccacctccagggttcatgccattctcctgcctcagcctcctgagtagctgggactacaggtgcccaccaccacgcccgctaatttttttttagtagagatcgggtttcaccgtgttagccaggatggtctcgatctcttgaccttgtgatctgcccgcctcggcctcccaaagtgctgggattacaagcgtgagccacagcgcccggcctacacgtggcttattcttgtcctaaccgttggctccaattggcggccaagctagagtgcaaatatatgaaccttttcccctactctgagttctcatgttctccccttggggtccctgcacagtacagaaacagactgtggcatggggattcttagagattctgttcaatttgtccaaatactttagttacagttgtatggactatatgatggttcaatcatgttgcaataagttttgacacagtatgatgcttattggatttggagggaacatgttgataacccactttgctcttatttgcaaggacttaggaaggtattcatgtaggtcagtgatctcaatacttcaagaaaccctggggaaccacagaggcatatcctgagattattacaaaatgttgccctttctgagccatcattttaattttcacttttagtcttgacaaagtgtatagactcaggagccagggagatcgaggtcagaatgataagtcattaatagcttggcaatcttacatatgaattaaagcttctaaagtacaatgttctttttttttttttttttttttttgagacagagtcttactctgtcacccaggctagagtgcagtggtgtgatctccgctcactgcaagctccgcctcccaggttcacgtcattctcctgcctcagcctcctgagtagctgggactacagatgcccaccaccaagcctggctaatcttttgtattttcagtagagacagggtttcaccatgttagccgggattatctccatctcctgatctcctgaccttgtcatccgcctgcctcagcctcccaaagtgctgggattacaagtgtgagccaccgagcccggccctacaattttcttacaacaaaaatgggatgataaaaattttaccttttaacaaaaacacctaggacacacaatgcagaaaaaacagtctctttgataaatggtgttggaaaaactggatgtccatatgcagaagaatgaaattaaatccttattccataccatatacaagtatcaactcaaaatggcttaaatactgaaatgtaaggccccaaactatgatgctactagaaaaaaataggggaaaagctccatggagttgctctgggcaataacttatggatatgaccccaaaagtgcaggcagcaaaagcaaaaataaacaaatagcattacatcaaaatgaagaactgcacagcaaaaaaaaaaaaagaaaaccaagagagtgaagagaaaatgtagagagtgggagaaaatatttgcaaactgtgtatctaataagtggttgatatgcaaaatatataaggaactcaatcaactcaacagtaagaagacaaatgacctgattaaaaaacaggcaaagtacaattagtagatgccaatgaaaaataaaagcaaaaatatgggcaaaggacctaaacagacatttcataaaagaagacatacaaatggccaacaggcatatgaaactatattcaacatcactaatgaggaaaatgcaaatcaaaacctcagtgaggtgtcaccttacacctgttagaatcgctattgccaaaaagacaaaaaatagcaagtgttggcaaggatgtgcaggagagggaacttttgcacacagtcggtggaaatctaaattaatacagccattacggaaaacagtgtgaaggtttctggaaaaactaaaaaaaaaaaaatagcattacgattgatccagaaatttcactgtggagtatatacccaaaggaagtagcatcagttttgacagagatatctgcactcccatcatttattgcagcattagttgtagtaccaaagatatagaatcaacctaaatgttcatcaatggatgaatggataaagaaaatatggtataggccgggcaaggtggctcacacctgtaaccccagcactttgggaggccgaggcgggtggatcacgaggtcaggagtttgagaccagcctggccaagatggtgaaacaccgtctctgttaaaaatacaaaaattagccagacgcagtggcaggtgcctgtagtcccagctgctggggaggctgaggcaggagaatcacttgaacctgggaggctgaggttgcagtgagccgagattgtgccattacactccagcctgggcaacagagcaagactccatctcaaaaaaaaaaaagaaaaaagaaaagaaaatatggtatatatatacacacaatcaaatgctacacagccataaaaaaggaaaaacttgtcattgatgatagcatggataaatctagaggaaattgtaagtgaaataagtcaggcacagaaacacaattaccacatgatctcacttacatgtgtcatatacaaacctgatctcataaaagtagagagtaaaatggtggttcttagggcctgggatggttggagggtgagatggggagatgttggtcaaaggataaaaaattttagttaaataggaggaataagttcaagaaatctattgtatagcattgtgactattagattagtgaggtagagcatgtgaaagattgtaagagcacaatgccttcacatattatttcatcaataaaggtcagcccattgttattacaaaaacaaaagcaaaataaagactatctgaaaattgttagtagggtgagttaaaactagagtgagcacaggacctccgatcaggcgactatagtagtttagaacagaggcagtgagttccttaactagagtacaggagaagaggaaataaaaagtatagaacaaataagagaagcatttgaaggttcgattgaaagatttggtaacattttagaggtgggcaagggaaagggaggagccagatgtgaccccgagatttctgagtcagaataagcaaaatttggatgctgccattcaatagaaaccagctggtaagtttttcttacctttaatttttagttgggtgtgtgtgtaaaactgaaataaacccaggaaaaatctataatcaaatggttttttgctttaaaataaaaatagaggccgggcacggtggctcacgcctgtaatcctagcactttgggaggccgaggcgggtggatcatgaggtcaggagttcaagaccagcctggcaaacatggtgaaaccgtgtctctactaaaaatagaaaacttagccaggcacagtggcaggtgcctgtaattccagctattcgggaggctgacgcaggagaatcattttaacccgggcggcagaggttgcagtgagccaagatcgcaccactgcaccagcctgggcaacacagcaatactccatctcaaaaaaaaaaaaaagaaaatatagattcaatgcttatttgttatgaactgataatccaccattatcacaaatacctcttgcaacttgttagctcctttgcagattttttaaaaattcctacttgcaggcttggttcagaagaacctgtaaaaggagatccctgaaatcagaaggtgtaacttctctaaacctgcatgaatgagaaggcagatatttgtgctttctgctacgtacttactttcagaaaatttgaataaagacaaaggaattattgttatttttttcagtgtgagaaaatgtctacaattattggtgatgcatatgtaatgttgatctgctttttgttttgtttttagacagggtctcactctgttgctcaggctggggtgcagtggcaccagcagggttcactacagccctgactttcccggcttaagtgatcctcccatctcccatctcagcctcctgagtagcttggactacaggtgtgcaccaccacgcctggctttttttttttttttcttttggtaaagatgcagtctcactatgttgcccagggtcgtcttgaactcctaggcacaaaggattctcctgcctcagcctctgaaagtgttgagattacaggcgtgagccaccacacccaacaggtctgctttttgagataatttttcttttttttttttttttttttgagatggagcctcgctctgtcgcccaggctggagtgcagtggtgcgatctcggctcactgtaagctctgcctcccaggtttatgccattctcctgcctcagcctcccgagtagctgggactacaggtgcccaccaccacgcccagctaatttttcgtatttttagtagagacagggtttcattgtgttaaccaggatggtctcgatctcctgaccttgtgatccacccgcctaggcctcccaaagtgctgggattacaggcgtgagccacaacgcagtcttgagataatttttcaaaaaataaagagagaataagaaaaggcaaaagaatacataaacaaaatcttggaattattgaatctgggtgatggaattatactggatctttctttatagcttttttattacaaaaagaaaataagtgataattataaataccaaaaatcaagatactttgaatagtggaacaaacagctggaaaactttgagatagcttactgctggaacacgtgctaaataaataacaagcagttttgttcttggttctttgttacttgcagttgaacacgttaaaaccaatacccctaattctactacactttatgttatttttattatttatttatttattattattttttttttttgagatggagtctcgctctgtcgcccaggctggagtgcagtggcgcgatctcagctcactgcaaacactttatgctactatgaatacaattttgaatttatatttaaacccattgacaaaagtacagattttctcatagttttaagagctgactataatatgaagccttaagattgacagagcatttttccttttaaactatagtgctcttcaaaaaggtttataaattagtctatgtaactagatcattcaaaagagtaattaagctttttacacatatacaataagatttgcaagaagggcaaatagacaacaaaatctgtgtatatagaaataatcagtttaaggaagtaaaataaatatatatgtaaataaatatttgtagttggtgtgggtttcagctgagagacggcagctcactcacacctgacagaccataatctattttcaaagtagggggataatcagaacagaaagaaatgtaagtgtcagttaactcaagtaaagtcatgtcctgcttctcactaaatgctcacaatataagctacatacaataaaattataaagagatataaatatgagtctctactaaaattgtactttagcaaacagctaacagcatgcttcattcatgtcatctttaagtaaatatatgtagtgcccacaaaccaaactttcttttcttcaataatcatgaaaaatataataccagcaagtttggtcataattttctatgggtaaaaatcactagatatttaactatacttagtggcaaaaatcacatggtatcttagcaggttttctctccaagaggttttatttgatgtttgacttaaaggttatgtagtgccatgaaagggcacatagcctatcttttcttttttctaagtttcatctaccaccacttagtggatagatatttcttgagtaccttcacttagaattctatctgaggcttttaacaatatcaatagtcattttgcccatgtgtgtagaagatctgtggttgctcgggggttttgtttttataacacactaaagtaaatcagaagtgaaagcacttctctctgagattatttttaaatctaaacaaataaataaactcaagggaatttaattttgataaaataggactccaggaaaatctgtctcatggcctttctgaatgaagaaaatggaaataaaatgtaaatgtgattttggagatgtgtcttccacaaaacaagtgttgacaagataatctctccatttgttccaggtcctctaattctagcactctataagcataaaaataatctaattaagtttaatgctttgaaatatttcctttattgcaaatcagtacccagatgaagaataagatgaaaccacacttacatgactctaaatacctgagatttctgagtaaggtggggaacaaagatctgtttctctaactaaaggatgattagattaatttttccctccattagcagccctatatctttctccatcctctctcacttgttactcaactatttgagcttctctatcactaaacttataacgtattccctgcctgggcttcaaagcgatattcacattaacagataaaaagcttcatgcactgtctgagctaagactgccacagtaaactctgaaatgatgacatgagagcatgataaatatcctgacacaaaaaagctatttttcaggggaggccactaccccataagcaaacctttgttgctctatctgtgaactcaaggatctgtcctcccattgaaaggccccagagtcgacaggctgagtactccaagtcgctgacaccaggggacagaacaaagaatctgtccaagtcttgatctccttagctcagcgcaggccaagttcagctcagcgatctatcaaagtgctggaatgtgcagcaagtaaatacccacattctgccaagggagaagaaaagctggaccattgactactgttctgggacaaagcaaattctcccacatcaaaagagcacaagcagccctcatccaggtctacactgtataatgggtagattttcggcgagtgtgcaaaagataaatggtgcttttatctcacattcccccaccccccttgcaatgagagtttatgttagagccacttaactgcgtggagtgcagcttggtggattacctgtttgtatgactcagtacctgacctgatcctgtggcgagaggagacgggggaggatgagagttttgtaaaatcagttttgctttgaagggatcttcagcaatttctgaagcctcacaaagacctctatacatactggcccttataaggagaaaggattagaagggaacaatgcacccagtagagaagttcgtcttgtatttctagttattttatgagtttagacttattaaattacaagctttaaaatcagccactcattattgaaaaaagtgtggaattgtgaattaaaagcgtatctctgagacagttgtcactggctttggagctaagcatcccgggaagtcagataaggtttcatcagagaaagggaaatgatcctgttatgaataaaaattgaaaggttctgaaagtcacttctggaagaccagcatggtgaggacaggaatcttaagtgttaacaaggttggacttaaatacctaaaatgattaattggtcaaactagcatgaggttaaagcttttttgttcctaaaataccttttgattccaggaagaaattcttttccccaagccgccctgagtgaaccattagtttccatttcagtgatctgctttctttctgtgtgtaatctcaagtctcacctgagggcagatggcggggcgatgacaatggcagcctatcagagaatgtgatttccaatctcagctccacaatccaataccacattatgtactaagtctagctattaaggatgtctaaggtctaaagttaatagtaaatacttttgtgcctgccacagttctttttattttccaggaccaaataagacaaatgcatgtgaattggtttggagaagatttcagattaatcttcaaagtaagattgcaccttaatgaacccatcttcggggtaatttgagagtatatcttaccaatacggagtttaaatttaatctaaaattttgttctccattctgttcccagttttcttctctttaataaacaaatcactggactacatggtagaaaagctggtttctgaggacattctgtcctggaatatcatttgattcagaagctctcaatttgaaacaatttttagttgtgaccaaaagtatatatttgaacaggttaataagcatttaaataagtttaaaatcaaggtttcaatttcaaacaaaaacagatgagttattaactgaagcaaaatatgtagatttctaaagctgataaaagctctaatttaagaaaattaatattaagaaaatatttcaaaacatatactttttaaaatggcatattagagaatatttgttcatgtttaaaagatttatttattttaacaacaaaacacagctttaatcacaaagtatagttattttttaacaactttattgagatacaatttacataccataaagttcactcatttaaatgtacaatttaatgggttttaatatatttacaaagttttccaaccatcaccataatctgttttagaacatttttattgtcccagaaagaaatgtaccaattagcagtcactcctcattctccctgactccagccctcagcaacaagtaatatactttctgcctctaaagaattgagtagttcatgtaagtgggcttttttcaaaaccaccacatgctgtatgaactcaaggacatagtactaagggcttctttccctgatcacaatgtctttgagttccattcatgttgcagcatgtatcagtacttaaatcctttaaattaccaaataatattccattgtgtggatgtaccacatttgtgtacccagccatcagttgaaattttagccactgaagaagtgcaaacaaaaccacaagataacactacatatccactaaatgactatatttaaaaagacaggcaatagcaagtgttgggaacatgtggaaaaactggattcttcatgctttgttggcaagaacgtaaaattatacaacctctttgtaaaagagtatagcagttcttcagaacgttacctacccagttaccataccatcctcaactccactcccagtgtacgttcaagagatacgaaaacgtacgtccacataaagacatgtacatgaatgtttgtagcaacaccatgcatattagtgaacatttattttacacgccttttttacaaacatatttctaatataaaatttgatatgtctaaattctatgcaacttaccaaatatcccatgtgacagaatatgtttcagggaagctttggagaggtatattgtgatataacatagcctggtatcaattatcagtttcttgaagaacaaacagctttttctcttgcttgtttttgttttgattttaaatctcatcagggaagcatcattaaagtagaatttctattttctgaaaaagccctcatcagccattattaagtagaatggtgtcactaaatatgacaacataaagaagcatgttactattattattattttgatgagagagtactttgtctttgatactttagccagagttacattcttcatcttcagagagctcccctcttgattttagtgccctagtaggtcaccaagtcagcaagctctgaagacatctaagttgcctacacgtttttcatttcttgcttattttcacttcgtttctcacagccattgctctatctgcctttgtgtgttgcttgagcaaggctgcaggcttcttaaagattgcattccaatgactctgctttctccttatgtctacctcagggtcagggcgttccaaggtcaggaagaaaagggaggaataattgtatactgaaaaatataaacagacctgttttgctggggtactcagaaataaggtaaggaggtgccgctgcagagagcagaaatgggtaaattccatcggtccatttcatccacagtttaacctcttcctgatcagatcagtcagttcccactgcttttcgtttttagtgaagcacagttttacaagacgatcttagggacttgggacataaaacttgaaaagcattctcaatggtaaaaattacatgcatttttgtgaatgtgtcagtcactccttccttgtaccctacacgtgcctagactagtgccaggcacacagcagtttctcaatacatgtctttaaaacttatgaactccaaaaatgaggagaaaagctgaagctggagacaggaacatattctgcaagtcctaggattaaaataggagagtgaagtgatcgggtttgggtttcagaaggaattctcctgtctcagtgttgaagatgggttggagaagaacaaaggtaagaccatctatgtagagaaaatgcactttttgcctaaaccagaggaataaggaggaagaggtggcattctacagatgtgaaggcaatttatctgtgaagctgagggactcgggatgtggagggagaaagggagggaagcacccaagattgttgtgcaggagctaagcttagctggggaccacgggaggcgcctttacctggggcgggaccttccttaggtgggggttgaggaagaagcggccaggcttggcttccatcgaggtttctgtatctgggtgatacctggtgatgtgtcgacaggcagtgggttaagaaggcctcaatttcaggaaaggactatggcctggtcacatacattagcgagctgtctacatagaggtggcagtttacatcttgagaatggttgcttccaggaaaagagtataggatgagaaaagcagtaggaatgaagaatgaaagccccgcctcaggcgtgggtgaaaccttttaccataaccagaggtgctgggccattgggaaaatgtgtcattattaataaagcttccgccacccctcttctgggttgaatttttccccccatcaaacatcctatgttgaggtcctaacccccaacacctcagaatggggccctgtttggaaagaggttccttagaggtaatcagtcaagacgacgtcacactggagtaggatgggcccctaatctaacacgactgtgttcttataaaaagaaggccaggtgaagaagccgacacacaggagaacgctgcatggagactggagttctgctgccaaggaatcggtggaagccaggaaagagcctgcaacagatccttccgccgcacctccagaagaagcacagccctggggactgctggatcttacacttctggcttccagaacagtgagtcaatacatttctgttgttttagcggctcagtttgcggtcctttgttgtgccgactccaggaaactggacaatccccatgccgtgcaaagcaaacgttatattctaaccttcagtaatacaccctctcccaagtcctgacatttttctttttctttgatctttgctccctgattctcagaggttcctggatgggcaggtcattccgtgtgtactcaccaatccaggcccacaccccagtgccccgagactcaaattacaccagcaactctcagccacttcaaagaacctagtctgtccatatatggctcttaagtttttaggtttcagccctgcctgaaataagtgaagtaatatcattgtcctcaatttcctcatatggtgcttagattgcaagatcatttccagctcaaagtttctaaaagagttgaattgaaaatatttctcagaaggatgaggaggagtggcccaatcccttccctcacctcatcccttcttatcacgaaacttcctgggcttttatctgggcaagggtaggagccttcgtgtgacattaacaggtaaatccttggatttttggccatatctttaagcctttcctatagacctcttaaatacgaaattcccacaactggaatatataccgcattgatactatcttcccctttatcctaaaactgtcatctttaagcttcaaacagtactgtgatttgatgttaaccatgatgatttgtacaaccgtatttacaaggccacaactcaagtcatttttagatttcatccttctagactgtagccaaattcccatccataaagcctatctgattcttatttcagtgtactcctctttctctaccatcagtattggattattcgtcaattgcatttgtattctcaccttttctaactatactgctctaacttacaatttcaaattcaattttttttcataaagccactaaccacctaattaaacaaacaaacatcccattatagccttagaatctgcagctcaccctggtaagccctgcaccagactaatggtgttatcagcatgtcttaaatactgttatctaaatgttattgaaactgtatcacatgtcaacttgggaaaaaatgttgtgcatatttttgagataagaccactaagctggtccaaggaatatatgtgtgagtaacatttctcactgttttttttttaatttaatgtcattactatagcagcgaaatgcacaatacataaaaatattaatattctgccacgaagtaaaactatattgtcattttcatacctattagtaattcaagagaaaaaggtctgttcttctcaatcttagctttgataaaaattataaatatatttttaaaacaatatatattgtttaattaaaataaataaacaatatattgcactctttcatccaccaagcacaaagcaggttctgataaaaaacaaaatattattaattagttatccaaaagcatagttaatagtgtagaaccctgtttttaattcagcatttttatatgtaagagtttcatagttaataggaattggccattttataaatggttggtgacagcatcatactgaatgggatgcgattcttatggtatatgacaatagtctattccttcaaagggagaggtgacagggaggttaattaacctttcatcagttaagagtcctttatcgatgaggatgtaaagagaaattcatctcaaaacaatagtttgtgggtacgggttgttttacccattttctagataaaaggagctgaatttcatatccaaaatctagttgcagccacctacagccaagttaaccacatcgtcccatttctgctgatcagaaaggaagcctctagcaaaccatctatattaatgcaaagaacaactttctatccaaataatctgaatttaaatttagcagatttttaaattaataagcttttgactttattgttactgagattctaccttattgcaaactgggtttctttccaattctaaggagacagttattcttcttttttttttttttttttttttttgggacagagtctcgctctgttgccccaggctggagtgcagtggtacaatctccacttactgcaacctttgcctcatggattcaagcgattctcctgcctcagcttcctgagtaactgggattacaggcgcaggccaccacacctggctaattttttatatttttggtagagacggggtttcaccatgttggccaggctggtcttgaactcctgatctcaagtgatccacctgtctcggcctcccaaagtgctgggattacaggtgtgagccaccatgcccagcctcagaatggtttcttttagctgcttttagtaaagtgcaagagagaaactctgccttgcccctctcacatatgcgcgtgcacacacacacacacacacagaggcaggcaggcccacattagcacccatgagtagggaactgtagacttttcgttgtcttctttataaatcaatgggatgtaatgaatattttttctgatggctaaggccttatagctatattaatgggattatggcgccatcatgtggtaatatgacatttttaaaaattattttttactggctgggtgcagtggctcaagcctgaaatcacagcactttgggaggccgaggcgagcggatcatgaggtcaggagttcaagactagcctggccaacatggtgaaaccccgtctctactaaagataaaaaaaaatagctgggcatggtggcgcgcacctgtaatcccagctacttgggaggctgaagcaggagaatcacttgaaccggggaggccgaggttgcagtgagccgagatcgtgccattgcactccagcctgggcaacaggctgagactccgtctcaaaaatatatatatttttaaattatgaaatacttaaaatgtactaaaaagtacagaaataataacaaatacttgtgtacccaagtttacgatattactttatatatttttctaaattaaagaaataatcttcacaaatacacagatactatcccatctctccattctcagaagtaactactgacttctgagtattagttttgtttcttatgtaaatatgtataattcataatcactatgaaccattattttatcagttgaaatgtctacaacacatatggcatcattctattgagatacacattggcagatatatgtgtgtgtatgtatatatattctcttgcaatttgtggtattcacttaatggtaggttttgaagttttatctatttatatttgtagttctagttcttttttaacaacagtatagtagtaatacatctctttgaacaggacagtgaagttgattccatttgctcaatatgataaattgcactgcaaagaacattcttttacatgtcacagtgtataggtttcctctggagttaaaactttggcatgaaattgctttccaaacctgatgctcctgtctgtgtttgtaatgcctttgcaggcattaaaacacctcagctacaaggttgaatcaatgaggtgaaaacagaaagctttctcttgtgttcttgacgttaaagcgttgtttctatttcatcatggtgtgtaacgtttgctattgtttattatgcgtaccatttagcaggttaagaaaattcccttcccttccaaatattctaacagttttatcttgaataaatactattttaaaatgcacttttatatctattggaatggaatcaaacgtgattcctttttgacaatttttatgtgcttgaagtaaagggatattttacatgcactcagttaaaaaacaaaaacaataacaaaaacaaaaaacatttaaacaggatttcccccctccccagacgataaatggagtttttgctctatatctttgctaggctcaacatattttgaaatatgctttgtactgggtgtgagacgagccactttcattatgcctgccacagttgagcaagtataaatatgtaggtttctgttctcgtagccctttatttgtatatataaaatattacaaacactatacatctgggataattatcttggctagtcaattaacaagaaagccagatctatattctcctgacacaactggtttattattgcctttacttctacaacttcccctttgttaactctaagctctttaaggataaggagcttggttacttcatattctcacacagcttactgccaggcatgtagtagatctctacaaatgtttgtggaaagaatcaatgaccagcatcagggagaatcttgcttttattagtatttgagttattatttttgagacaaacacattatagcccctattttgttgggcataaattgattcaacaataatgaacagagagaagtttaatacacagaaagtgcaatggagttgcagtgtgagaggtttacatttttgtttgaacttcaagaaggagatatttaaggattaaaacctggaattggaaaatgaaaaggaaaaatgctattaaaaattagcaaaattttataaagaattttataaagaaacaaaattaacatctcaatgtaaaatatatcaccattgaaatttaaaactcggtaaacagtgggcatcttaattagacactgttgaagatcgaaacaaggagctgaacaacatgtagaagaaactaaccgtaatgcacagcatagatagagatggaaaacatggaggagaggttaagacacatgaagtacaaaataaggtccaggatatggtttacagaacctttaatataaaagaactgagaaacaggagtacagcaatatttcaagatataatgactaagagttttccaaattaaatggaataaatgaatcctcagcttcaaaaacaaaacaaataccaagagaaataaatgttcaaacatctcccatttcagacgaattttagaactgtaaaatccctcccctcaaaaattaaactccaaattacctataaaaatggctactaaaaacgataagctagaaaataccagaataacatcttccaagttctaaaaggaactgctataaatccagagatttgtattcagttaaactctcattgaagaacaacagagaaataaatagttttcagacaaactgcaaaaaatgtcatgaggacatgtcatgaaatgaacttctgaaggatgtattccagaaagaacaaaatcacaccgagaaaaattacacaaatttcaaaactgaaagtaagcaagattctgggaaacaggaaggtcaatctcgacaaacacaattttcatcaaaagagaagaatgtccaagaaaaggtgactaaaaaagtaagtgcaatgggaaaaagatctgaacagacacctccccaaagaagatagactgatggcaaacaggcataaacccatgaaaagatgctcaacatcatgtgttattagggaattgtaaattaacacaacaatgagataccacaacacacatactacaataactaaaatccaaaatactgacaacaccaaatgctggtgaaggtgtggaacaacaggaactctcattcattgctggtgggaatgcaaaatggttcggttcccttttatttgacatggataccaccatgaacacctgaatgctacctgtggtagcactgaagccttcgtgccgtatgttttttcctgtacagcaacgggcaggtagcatatacagtatagatccaccacacaaagggatgatcacattgcaaacagaatggagtagggtgacatgaggaacaagatgtttaagggatagataaagagatagataagtagatacaaatatagactgtgaaatgattgtcaagctaattaacacttcatctacttttttttttgtagtaagaacatttaaaatctattcttttagatttctcaaagaacttaaaacagagctaccattcaatccaggattcccactactgggtatatatccaaaagaaaataaattgttctacccaaaagacacaggctctcatatgttcatcacagacatgttcattgcagcactattcacaatagcaaaatcatggaatcaacctaggtgtccatcgagggtggatttaataaagaaaatgtggtacaaatacaccatggaatactacacagccacaaaaaagaatgaaatcatgttttttgcagcaacatagatgcagctggagggcactatcctaagctgattaaggtaggaacagaaaagcaagtaccacacgttcttacttagaggtggaagctaaacatttggtactggcagatgtaaagtgttcagcaatggacactggaggctgctgctggtggaggaggcaaaagaggggaagagttgaataattaactgttgggtactatgctcactacctgggtgacaggatcaataataccccaaaccttaatatcacacaatatgcccatataacaaacctgcacatgtacccctgaatctaaaataaaagttgaaattattaaaacatcttctctttaagcaattttgaaatatgcaaacattattattaactatagtcaccaggatgtgcaatacatcactgaaacttaaccttcctgttcaacttaaactttatatcatttggctgacatctcttttttccccatccacaacctcccctactccagcccctggtaatcaccattctactctgattctatgagttcaacggttttagattccacatataaatgagaccatgtggtatctgtctgtctttggctggcttatttcacttaccataatggtttccagtttcattcatgttgttgcaaatgacaaaattaccttctttttaaagtctgaataccattgcattgtgtgtaccacattttctttacccattcatccaataatggacactttttttcctatcttggctattgtgctatgaacatggcagtacaaatatttctttgacatactaatttcaatttctttggatatatacccagcagtgagattgctggatcatatggtggttctatttttaattttttgaggaactgccacactgttttccataatgactgtactaatttaaattcccactgacagtgtactttggttcttttctccatatacttggcaacacttgctatgttttgtctttttgacaatagccaatctaacaagtatgaggtgtgagttaatatctcacagtgggttttatctgcagctgcctgatgattcacgatgggcattttttcatatatctgttggctatttgtgtgtcttcttttgagaaatgtctgttcatgtcctttgccccttttttgatcaagttgtgtttttgctattgagttgtttgagctcctgaaattcttttatgagcttaaaatttgtatggttgggcatgggggctgtggagctaggattgctttgcaatcatctgtccaatgttctcatgcttttcctagatgtgttcctcattgagtaaccagccacgcacacaccatttccctcccagatgatgaccaaattcaggaatggccgtagccccagcttccgcattttagttcccaatggtttcacttcctcagcttctgcccatggatgccctgcctcctaatatttacacacgtcatagggcacagaagtatggacagaagtctagctctaattccaagatagaactggatttcccatacattctcagtttatacatgtatgctggactctaataatgaggttatgcttaacgaaatacaaccaaattacaggcaaatactgttgaatgaaagagtcttttaaaatcattatttatagcatgtcttacctctggaagttagctggtcttttttctgttttttcaagcagatacaaagatgttgccaccagagagcaccatggtactgccttaatctttatatgtcactttttcattaatccctcatttcaggggtgacaaataatagcgacgataatttaagccaaatttggaaaattctttcattctatttctgaatttaaaaatcaattatgaaaacattttaaaattgtgtttttaaacatcctaacataaaaatttttaaacagttttgctaaaaattgattctggtgattcaatgttaattatgttttacataggtaagttcatatgccatctatttgctgattctcatgagatgtttgtgctaataatttgtgggttttgttactttaagttaggtttagtgtaaaagtctaggttcatcctatttatgaatcttgagaattgctgatgtgtctttgaatattgtttcagaattatgccattcttttactgaatacacatttatgcctatctttcccctttcctcatctgcgactcagtaaataatatctaagggtaccttcagatctaattgtctattattttacaccaacatcttcagaatgcactagccagaaaatactgcttcagtgatacaaaacatgaacaatgtctgtgtgagtgaaattggactgtgcaattatgttctcttttataaccctgatgatgtttctaaaataaagcttgtatgctcagactccccaaaggagtaaacatactagagtttcttcatcctttgaatgatcataattagataaaataggcaccagtgtttccattgtgtgatatatgcttcatactccattttctgaagtgcctgacaatacaaaattgtgtctgtatgatcaaactttgtgtttggtcaagtatggtattaccagtgtgcttatcaagcttaatcagaaggcattacctgaataacgttttatgatatgtaaaaaatacagtctcatatgataaatataagctacccctcaagacatacaaaataattcactgctagttttgaaagctatgacttcaaattaaaatgtgtagaaaatactccttattacagctcttcctgtactggctctaaagaaataatccaataatctattgattattttcctcatagacattcctttaacaatgtaaagcttctgtatttgggttttgtttctggtagggggagcaaaattgtgaaagggacacaagaaaatgtcaatagtttatatgaaagaaatgcaaattttatgatttaaaataacagaagacatgctatcacggggaagggggcatctgtcactatagctctaaaattatatgtctctgatgttcagttaaatggaatatttgtgcttcaggaaactttaatttgggttaaacctgtggccatattatcaatatatatgagccttccttattggcttctggtggtgattaaatgagaaaggtaagggataaagttctctccagattcatttaaacgactgtctcaaaaactgctctccagagcactactccaggaagagatcagggcgttttccacagaaaaaaaactgatttggtgatcagaaaagtatagaaaagcccacttaacatatctccttcctaaagattcacaatgaacattattatttaagagctttttgaagtgcaaatccatgagctttttaaccctgagcaattgctaccaagctaactctgaaatttactgcttttagtcaaaatacactcttcagctaatgctttcttccagctggctgtcttcttgcctgccctgtgtcgtaaaatgggggtcccttactgcattatcaaggggaaggcaagactggaatatctagtccacaggaagacctacaccactgtcaccttcacacaagtgaagtcagaagacaaaggcgctttggctaagctggtggaagccatcaggaccaattacaacgacagatactgtgagatccgccgtcactgaggcagcaatgtcctgggtcccaagtctgtggctcgtatcgccaagctcaaaaaggcaaaggctaaagaacttgccagtaaactgggttaaatgtacactgtcgagttttctgtacataaaaataattaaaatacaaattttccttcaaaacaaagcaacaaaaacaaaaaaaagagctttgagaaattctggaataaagagacatgatggaaattttttaatacactgttgccaatctgtaagaccataaaggctgggcacggtggctcaggactgtaatcccagcactttgagaagccgaggcaggcagatcatgaggtcagaagatcaagaccttcctggccaacatggtgaaatcccgtcttgactaaaaatacaaaaattagctgggcatggtggcacgcacctgtagtcccagctactcaggaggctgaggcaggagaatcacttgaacccaggaggcgaaggttgcagtgagccgagattgcaccactgcactccagcctggcgacagagggagactccgtgtcagacactggaagactccgtctcaaaagaaaaaaagacggacgggcgctgtggctcacgtctgtaatcccagcactttgggaggctgaggcaggcaagatcacctgaggtcaggagttcacgaccagcctagccaacgtggtgaaaccccatctctactaaaaatacaaaaaattagccgggtttggtggcacacacctgtaatcccacctattcgggaggctgaggcaggagaatcgcttgaaccagggaagcggaggttgcagtgacccgagatcacgccactgcactccagcctgggcaacaagagcaaaactccatatcaaaaaaaaaaaaaaaaaaaaaaaaaaaaaaaaaaacaactgagaaatggaaatccaggtttgccacttaccagctgagtgatcttggataagatatctcaattctctggctcttcttgacattaaattatgtaacacataatgctaaaggtacataggaaacatggaatagatattaggggggtttttaaccttctgtcttaacatgcttttaaatcctatagttttatagagcatgtgttctagtaaattagttgctaatttatgtttctattcaagaaaatcatttgctttcatgcacccagttctatggtgggcaccttgtgttcttgactacctgtcatccatccctctctctttccaaaagtaccctgatttattattcaggcattaacttttctacagtatagcctctgcatgtccagggaaatgtgcccaccccaagcttggaggttggctgtaggggttgatttaggaaaaggtaatgatgcaaatgagatcgatgtgactcaggagagtgctcctgtgtgcccttcctagccagggtgtagacggggtgctgtcctgtgtggggcattctccgtctgcctatccacatccgttctccaccctgcccctctaggctttatgtgttgaaaactatcttctgtggatttcgtcatgtacactccccagatctcttgtttggggatgattttggctaatggaagacactgcaacagaatatatagcaaaagaaaataatggctgtctttcatctttctctcccctcgactgtctcacagcatgttattgtgtagacctacatagcctctcctattaacttcaagactttcagaggctatgacgggaaaagaattgacatggcaaattcaaaatttctttttgtattctgaaagcaaagtaaagtcttagagctgactcctatcaattacttttatttcatcacatgaataaatgaataagaatataaaaaaattaatggagaataaacaaatatataaataaatgagaataagataattgaagatgctgtgatcatgtggcattccatttgttgtggagggacacacacagatgaggagtggacagttttaactggatggggacagagatgtccaggaaagtggtttcataaaggagatttcaattaagctcatttttcagaaataaatattttcaaagaacacaaagaggaaaaggaaattactagcaagtgattgttcaactgcttaataaaaattacagttctgaaacaaacatattttgagaaactttatgtagttcattacggttgaaatactgagtctgaagcatcagaaacagggcaagagacccgtcagaggcagaccagggcgcctcccagccaggccttttccacaacatgagagaagtgggcttcatccttctgtcagagggtttgtgtttatgaatgttaggcaagaggtaaatatgaccagtgctgtaccttttttttctttttgagaaagggcctcactctgttgcccaggctggagtgcagtggcgcaatcttggctcgctgcagccttgaactcccgggctcaagcaatcctcctgcttcagtctcctgagtagaaaggagcacgcaggtggaagagtacactgacagacaccagcaggccagtaggccatcgatgggtggaacgaggcagagtttgcagggagcagtgggagaagagtcgagggaaaatcatctcccttctggcttcccccgtctgctgagagtgacttccgctcaataaaaccttgcactcattctccaagtctatttgtgatctgattcttcaggtacatcaagacaagaacctctgcctcccaggttcaagcgattctcctgccttagcctcccgagtagctgggactacaggtgcctgccaccacacacggctaactttttgtatttttttttagtagagatggggtttcactgtgttagccaggatggtccccatctcctgacctcgtgatccgcccacctcagcctcccaaagtgctgggattacagacgtgagccatcgtgcctggcctaggttttttttagaatttcccaagatggtttaaaatttatatggaaatggaaataatgtagaatagccaatgtaatcttgacaaagaacaacatagaggaagagctccataacattggtctcagcaacgattttttgaagacgacctcaaaagcacagcaaaagcaaaaatagacaaatggggttacatcaaactgaaaagattttccacagtcagggaaacaactgcagagtaaacagataacctacaaaatgggggaaaatattgcaaatcatacatctgataagtggttcttatctaaaatacataaggaactcaagtcagcaaggaaagaaataccccagttaaaaaatgggcaaaggacctgaatgcatatttcctgaaagaagacatacgaatggccagtggttatatgaaaatatgctcaacatcactaatcatcaagcaaatgtaaattaaaaccataatagaataccgcttcacacctgttagaatagctattaccaaaaagatgagataacaagtgttggcgaggatgctgagaaaagggtatccttgcacactgttggtaggaatgtaagttgatacagctgttatgaaaaaccatatggagtttcctcaaaaaaattaaaaacagaactaccatgtgatgcagaaatcccaacactgattatataaccaaagaaaatagaatcagtatgccaaaaatatatgtgcactgcatgttcattccagcattattcacagtagccaaggtatggaaacaacataaacaacataagtatccatcaatgaatgcatggataaagaaatgtggaatatacacgcaacataatgttagccttaaaaaagaagaaaatcctgtcatttgtgacaacatggataaaactgaaagacactatgttaaatgaaataagccagacacaaaaaaatactgcttgatctcacttctatgtggaatctaaaaaagctgaactcagatgtagaaaatagaaggagattagcaagggttggggtttggggagaggttggggtgatgctggtcaaaggatacaaaatttcagttaggaagaataaggtcaagagacctattgtacaagattgtgactatagtcaatattgtgttgtattttttaaaattactaagaattgctagattttaagtgtcctcaccacaaaataaaatgtgaggtaatgcacatgttaattagctcaatttagccattcaaaaatgtgtgtatatatatatatatatttcaaaacatcatgttgtacataattatatacaattttgtcaattaaaaataaataagtaaataagaaatgtgtaccaaaaaacaggaagaaagaacaaagggtgtacactatctgatttcaagacatactataaagctaccctagtcaggacagtgtgacactggaataaagatggacaagtatagttcaatggagcagaatatacagtgcagaagtaaattcacacttatgaggttaactaatttccaacaaaggctgatttccaacaaaggcactgaaataattcaatgagcaaagggaaatctttttaataaatactttggaaaaaatgaatagctacaagggaaagctaaaataaaattcaacctctatctcacagagtatacaaaagttaattcaagatggatcacaaacccaacataataactaaaactttaacattttgagggggaaaaaaacatgagagaagttctttgtagccaaatagatatttcttggactcaacacagaaattactaattataaaggcaaaataattacaagttggattacattcaaataaaaaagcttctgttaatcaaaaaacatactcctaagaaaatgagtaggcaagtaacagagaaaatgggagaaaatgtatgcaaaacatttatctgacaaagaactgttatcccaaatacacaaaagatagctacaactccgtgaaaaagataaacaacccaattttaaaatatgcaaaagactcgataaacactttaaaatggaagacatacaaatagccaaaacgcatatgaaaagatagtcaacattattcatcatttgaaaaatgcatataaaagcacgatataccactatgctaccagaatgtagaaaattgaaaaaaaaacaacaggggctgtatgtagagcaaacagcaatctcatacattaatagttgttatatgaaaatagtacagccactttgaaaacatttgtggcagtgtcttataaaataaacctttacctatactctggcccgacaactccacaccgaaatatttcgcaaaaaaaaagtatgttaacaaagcttgaacaacaagatttatagcaactttatttattatgtctcaaacaactaaaatgttcattaaccagagatcagattttaaagttgtagtacatttctattttttttttttttttttttttgagactaagtgtcgctcttgtaccccaggctggagtgcaatggcgcaatctcagctcactgcaacaaacgcctcccaggttcaagcgattctcttgcctcagccgcccaagtagctgggattacatgtgcctgccaccacacttggctaatttttgtattttttatttacttatttatttttagacggagttttgctcttgttgcccaggctggagtgcaacggcgcaatctcggctcaccgcaatctcggctcaccgcaacctccacctcctgggttcaagtgattctcctgtctcagcgtccctagtagctgggactacaggcatgcgccaacacgcccgactaattttgtatttttagtagagatggggtttctccatgttggtcaggctggtcttgaactcccaacctcaggtgatccgcctgcctcagcctcccaaaatgttgggattacaggcatgagccactgtgcccggcctcctaatttttgtatttttagtagagacgaggtttcaccatgttggccaggctggtcttgaactcctgacctcaggtgatccacctgccttgacctcccaaagtgctgggattacaggcatgagccatcgcgcctggccaaaattgttgtacatttctagaatggaatattaccaaagaagaaatactattgctacatgcaacaatatagatttaacaagctacacacacaaatatgatgctagctacctgaaattctaggttataaaaaactatggttaaaaaaaccagaaattgtgttttgctcttgagagaaggaattaactggggagaggctcgagaaacatcctgtaatgatagaaaatttctatatcttggttaagataataaacaaacaaccccattaaaaagtggacaaaggacatgaacaaacacttttcaaaagatgatatacaagtggccaaaaagcatatgaaaaaagctcatcatcactaactattagagaaatgcaaatcaaaaccacaataagataccatctcacaccagtcagaatgactattattaaaaagtcaaagaataacagatgctggtgaggttgcagagaaagggaagacttatacactactggtgggagtgtaattagttcaactattgtgggaagcagtgtggtgactcctcaagtaactaacaagagaactaccattcaactgagcaatcctactattgtgtatattcaaaagaatacaaattgttctaccataaagacacatgcatgcatatgttcactgcagcactattcataatagcaaagacatagaatcaacccaaatgcccatccgtggtagaatgaataaagaaaatgtggaaaatataaatcaatactatgcagccataaaaaagaacgagattatatcctttgtaggaacatggatggagctggaggccattatccttagcaagctaacacaggaacagaaaaccacataccacatgttctcacttataagcaggagctaaatgatgagaactcatggacacatagaggggaacaacagatactggggcctatcagagggcagagggtgggaggagggagaggttcaggacaaataactagtgggtgctaggcttaagaccagggtgatgaaacactctgtacaacaacccctgtgacataagttcacctgtataacaaacctacacatgtacccctgaacttaaaataaaagttaacaaataaagataggaatgtgggttacagaagtatatgtacttgtcaaaactcttaattgcaacttttagatctgttaagtttcactgtatgaaaattttagttcagaataaaagaattctacacaacattgacctttacacagtagtttatctttctggtatggcaattctgaaatttctttctgtgtacttgatgattgagtaaatgaatgcgtatattggggaaattgggagtcaggttggttactgatggagagggggaaaggtgaaaatgcaacctatggtgttgatttggaactgaggacataagcctgaatacatactttataataggtaaatgaaagatagataatgatagacaaatcaactagatagatagatgatagattagatagatatagacagaataatagatttagttgtatttctgagctctgtatgttgagagtacctagaagcaacggctctttgaaagcaatgaacacactagtcacactagtactagtaccttagtaaaagattctccatgacatgagaaaattctctacaatgaggagccagaagttaatacaaagaatagcacaggaaaagtactgaatgagtctggaagatcttcttgtgttataaagtaatagagaagtcaaaagtatgatagacatatatcaaaagggcacaggcaccagcttgaagggctcacattggtcaaatctaaaataagtaaataataattgtaatagattataactctttaaataagtatttatgatcccattctgatgtaataaaataactaagtaggtcttactagcaccttaatattgaactttccagcctccagaactgtgagcaataaatttctattgcttataaatttttttaaaaaaagatttcagcctactttcatctttgcaacgtgatcatttttaccattattcaaataaaaatgttcccgtctattataaaaagaaaatgactaagtaaataaacagaaggtaatgccaacaaataaatgcacaataatggcgttagaaaaatcatcagcgggtgctaacagcagtggataaagtttgatgtggaacagggtatttacatagtcttaaagtgtctcctaataacttacttatctattacaagaggaaaaaccgtaactttccaatggagagactttattgaccataccttaatcaaaaaatcaaacttaacatcagccacattagtacaaagtgacattacacatttcttgacgatatactgagaagaacagagaataatttctatggcattcctgtgaaaagaatcaaaagacctgaatttgtgaaaagtgtcaaggtcaagaaagaaaaaaaatgtctgaggaactgtctgagttaaaggagactgaatgcaattgaaggtgacttaatgcaatgcttaactctggaccgggaacaaaatagctacagaggacattgaacagctgatgaaatttgaaaatagactgtcaattaaatgtcctgatttttataagtgttttttgattatataagatgtacctttgttcttaggaaatgtgtgctaaatatttcaatgataaaaggagcacagtatcttcaattgactaagaagtggtttaggaaaaataaatagttaactgtatattatataactctatatattatgtatattatctattatgtatatgtagagaaatacatataaaataaagacctataaataattgttactaagtgtatatatatatgtgtgtgtgtatgtgttccttgtactattcttgaaatttccccatatctgaaattacgtaaaatagtgataaaaaagaatactcattgacagatggtaaatgggaaatgcatcaaaaattgtatcttccctatcataatttctcaaatttgtgtagatgagaaaattgcaaattgtccaaagatactgacagtgagtgaaggtgtctgaaataaacagcataggtataaaaggtggctgaaagatcaacactttcctgttcaaaaatgacaagcaatctattgtgcaaagcttcctgcatggtaaaatggattttaaatgtcctaacatcacatattttcataaagagcactctggcccatagagctgcttgctatatgactactagagatacgaaagaatttacttcttactgcacttgataaaatgacaggaaatgacaatttaaaaataagattgtcattttgtttcaattttcaatccaagaaaactctttattttcaccccatgcctatgaatgcttggaagaaaatgtgtcaagacttcgtactaacacagttagaatgcaaccttttgacttatatcttttcccctattatagaaaattcctggcataagtcacttacttgagttctgctctgagtgataagatgcccttggcagcttgaagactgtgagatgataggctataaaacactgaatctgggaaggacattgttgggtaaatactgtgttatgaatttgtgcttggggctgagccaaatgtggaaggacgccagtctacagctcagtcagtattagtgacatccaacaagctggggaaacagcattccatgaccatcaaagtagcagcaggcacaacgttagtgaagaagcattctagtgttttgttttgttttgttttaatacatattatagtgagagtagggaaataatggagaaattagctcacatgagcactgtggcatatttcattttgtttttcatactaacccagggaaatagaaataatcatacttttttttttataaaagtgacaatagattcaacgaggttaagcgtatcactgaagctgcacagttattgtggaatggagtcgggattcaaatctattctgctgttccacgccaaagcctacgttcaatccctatgccacagtgcatcctccaagagacgcagtgatagtcttaactctccctcagaaaaaaatgttgaaaaagaaaaacagctgacacaattttcttacttcttttcctctgaggtcttgtcttaggcaagctgccattacttcgaattgggaagcgactctcctgaaggtgccaggaaagttcacgtgtgaagggtgaaggggtggcctgcccctccacacttgtgggcgtttctcatcaggtggaacgagacttgagaaaagaaagagacacggagacaaagtatagagaaagaaaagtggacccggggaactggcgctcagcatacagaggacccgcgccagcaccagtctttgagttcccttagtatttattgatcgttatcaggcgtttctcggaaaggggaatgtggcaggacaataggggaatagtggggagagggtcagcaggaaaacatgtgaacaaatgtctctgcctcataaacaaggtaaagaaaaaagtgctgtgcttttgatgtgcatatacataaacatctcaatgccttaaagagcagtattgctgccagcatatcccacctccagccctaagcggttttcccctatctcagtagatggaatatacaattgggctttacaccgagacattccattgcccagggacgagcaggagacagatgccttcctcttatctcaactgcaaagaggccttccttcctcttctattaatcctcctcagcacagaccgtttatgggtgtcgagctgggggatggtcaggtctttcccttcccacgaggccatatttcagactatcacatggggagaaaccttagacaatacctggctttcctaggcagaggtccctgcgggcttccgcagtgtttgtgtctctgggtacttgagattagggagtggtgatgactcttaaggagcatgctgccttcaagcatctgtttaacaaagcacatcctgcacagcccttaatccatttaaccctgagttgacacagcacatgtttcagggagcacagcattggcggtagggttacagattaacagcatctcaaggcagaagaatttgtcttagtacagaacaaaatggagtctcttatgtctacttctctctacatagacacagtaacagtctgatctctctttcttttccccacacacgtggcagggagcgtagccaaggtcaccgggggcagagtgtcattacccatggatattccagcctgaagtgctgctagtttcaatgccaggcctacactggcgcggataaaataaagtgcaattttaactctgccgacaaagagctcttccctcttctaaataaaaacatagctcgtttgggattcaagtaaaggtgagaaatagaaaagtacccagtaagatttacaggtaaggaaaataaagtttttcaataggagttaagctactaaaatttacacagaatcaatgagaaaaagccattgaatacctacagtaatactagccaccatttcttaaccacctgttaggtagtggccataaaactcaacattttacacattatctcatcacattcagtcctcatagtgatcttttttttttttttttttttttttgagacggagtcttgctcaggcaccaggctggagtgcaatggcatgatctcggctcaccgcaacccccacctcctggattcaagccattgtccagcctcagcctcccaagtagctgggattacaggcatgtgccaccacacccagctaatttttttttttttttttttttagtagagacggagtttcaccatgttggccaggatggtcttgatctcctgacctcatgatccacctgcctcagcctcccaaagtgctgggattacaggcatgagccaccatgcccggccctcatagtaatcttatgaggtaaattttattaattaaatttcacaaagcaaaatgaggtttagaaaaaaataattaacttggccaaattccacagctggtaagcaggccatattcaaacctaggctggcaaacaccaaagtctttgctctcacctctaggctgtgttggctgtaaatgtgctaccaaagtgttgggagaacctcagatcttaatcatggtggcatccctggcaagtgactataatgtatgcagtagaaatacaatctacactattttacctatggggaaaaacaatatgaaaaagagaattatcacactattgaatagaaaagagcatccaaaaactgggtgttggcaatgttcactcgaaactgttccaagaagatgtagattgaccttgagattaaaaatttgtagcacatgaagaggagtcttctgttgtggaacaaaaatagttcatttggcatcatttcatagcttggtgaaatagctctcaaatgtattgactgttttttctctaattatataatcaccgagcaatattctgagtaaccaagaaatagtacagtgtgtataccattgtattttatgaaaacaaattatgcaatcagaagtagtgctttttttttttttgagtctcactcttgatcacccaggctggagtgcagtggcacaatcttggctcactgcaacctccgccttccaagttcaagctattcacctgcctcagcctcctgagtagctgggattacaggcgcccaccacctcgcctggctaatgtttgcacttttagtagagatggggttttgccatgttggccaggctggtctcaacttcctaacctcaggtgatccatccacttcagcctcccaaagtgctgggattacaggcatgagcaaccacgcccagccaagtagtgcaatttttaaaataaaattgaaatttatgtgcaaatgctgaaagatattaaatcttacaaaaatttaattcttaaagaaaaaggggtgattttaaaccttgccttgcctgtgtctttgctgtagatggaactaccttagttagaagcagaaaggcttcctgctccttttcaatattatcagatccatggtgctttttaaagacatcagcactttcttacagtgatttagggattatgatgcttttattttaatgttcattacaaatgcaatttaaaataattctatgtactatgataatattatccaaatattcattaagtggtagtggcagtataagaatacaaaaccagacttccaaatcaatgattcttagtaagataaaacaattttttaaaaaggaacatatgactgggtgcggtggctcatgcctgtaatcccagaactttgggatatcgaggcagatggatcacctgaggtcagaagttcgagactagcctggccaacatggcaaaaccccttctccactaaaaatacaaaaattagctggggttggtggtctgcgcctgtaatatcagctactcaagaggctgaggcagtggaatcccttggacctgggagatgtaggttgcagtgagctgcgatcacaccactatactccagcctgggagacaaagtgagattctgtctcaaaagaaaaaaaaaaaaaaaggaccatatacgtgtcggttaatgttagagacaatgttctgaaaataaagaaacagcattaaagaagcacacctgcagcaccttcgtgttggcaaagatcactgtacatcagccaaagataatgaaaaccttctcatggcatagctgcaaaataaacatcatagcaatattctcttatgctttgttttcagtagatttttaagctctgtaaaaagtattaaacttaacttgcatttgcttctatgtaaaagttactcttgggttacccaagttttgaattgtgaaggtttaaagtaggaattcccatcataaaataggacaatcatattttgatgcagagagacataccataccatagataggtgaaaaattattccagtcataagaaagaaaaacctcttttagaaattagtgaagtatttgtacctgatttataccttcttcatactttcatgtgatgtctgatcagctcttagaaactgaaaaaagaaatgattttaggaaatgccaccttaagagagctcttggatgaaggtcgcctgactggctgcatgccttgccttccctttttttttttttttttttgagacggagtctcgttctgttgccgaggttggagtgcagtggtgtgatctccgctcactgcaagctctgcctcccaggttcatatcattctcctgcctcagcctcccaagtagtcaggactacaggcgcccgccaccacgcctggctaattttttgtatttttagtagagatggggtttcaccgtgttagccaggatggtcttgatctcctgacctcacgatctgcccacctcggcctcccaaagtgctgggattacaggcgtgagccaccacgcctggccatgccttgccttcctttaagatgatagtccatccccaaacatgccagcactaaccttatgacaaagacaaacaacattccctttctactctaatttcataccatccattaaaactatttaatcacagagaaagaaaaaaattttaataaaacataacccttacagaccacaagagacagactaaaaccaacagtatatgggcaataatatagtattgtcttctggtggaaagtgtattgctggaaagcacattcctgaagctttttctactttctgtactttaccttcctatctaatttaggttttctgttgctaggaaagagatgcttctatccatgtgagaacagtatttacagctcttcaggaaattgttgccacttatataaaataccagtaacaatgacagaaaatattttcattttctcctggtgactttgttcccacttttacttcaataagactaccgttaatctaatttcagaaaaaaagggctgtagtggcctcatctaaaaattggagatgattgaaaagggcacatttgatttcatattttttattttttatttatttatttattgtttattttttgaggcagagtcttgctctgttgcccaggctggagtgcagtggcgcgatctcggctcactgcaacctctgcctcccaggttcaagcaattcttctgcctcagcctcccgagtagctgggactacaggtgtgtgccaccatgcctcgctaattttttgcattttaagtagagacggggtttcactgtgttagccaggatggtgtcgatctcctgacctcatgatacacccgcctcggcctcccaaggtgctgggattacaggcatcagccactgcacccagcctgttttcatattttttatttgacatattgtaagtttacatatttatggagtacaacttgatgttttggtatacatccatgttgtataatgatgaaatcagggtagttagtatacagatacctcaaatatgtaccatttatttgtgatgagaatatccaaagcctctcttctattttgtaatatacaatattttactgttaaccatagttaccctctggtgcaataggacaccagaatttactcatcctatcaaattgtaactttgtacctattcaccagcctctccatttctccttggcatccttttcccctctccaatctctagtagccactgtatactctctgcttctatgacatcaacgttttctttttgggaggattctacatataagtgagaccatatggtatttgtctttctgtgtctgccttacttcacgtaacattatctcctccagcttcatccatattgtcacagatggcaaggttttattctttcttatggctgaatagtattccattgcatatatataccacattatcaatttatctgtggatggacacttaggctgattctctatcttggctattgtaaatagtactgcaataaacatgggagtgtagatatctctttaatatactgattttatttccttttgatacatacctagtagtggaattgctggatcatatggtagttctatttttaattttttgaggagctgccatactgtttttctttttctttttctttttttgagatggtgtctcactctgtcttgttctgtctcccaggctggagtgcagtggaaagatctcagctcactgcaacctctgcctcctgggttcaagcaattctcctgcctcagcctcccaagtagctgggactacaggcgcccaccaccacgcccacctattttttgtatttttagtagagatggggtttcagcatgttggccaggatggtctcaatctctacactgtttctcataatgactgtattcgtttataatcccaccaataatatgcaagtgttcccttttcaccacgtgcttagcaacacttttcattgtttatctttttaatactagtcattctaactagagtgaggaggtatctcattttggttctgatttgtatttccctgattattaacggcattgagcacttttttaatatatctgttggtctttaaataagacctcaaaagcactggccacgaaagcaaaaatagacaaatgggattacatcaaactaaaaggattttgcacagcaaaggaaactactaacagagtgaagataacctacagaatgtgagaaaatatttacaaactatacatctgacaaggggttaatattcagaatatataaggaagctaaacaactcaataccaagaaaaaaaacacaaataatcttattttaaaatcagcaacatcaatggctgattagatgaaggaactgtggtacatatacaccatggaatactatgcagccattaaaaaacacaagatcatgtcttttgcaggaacatggatggaggtggagcccattattcttagcaaactaacacaagaacagaaaactaaatactggctgttgcatttacaggtgggagctaaatgatgagaacatatggacaggaggaggggaagaacagacactggggcctattggagggtggagagggaaggagagagaagatcagaaaaataactattgggtattaggcttaatatttgagtgacaaaataatctgtacaacaaatccccatgacacaagtttacctatagaatagacctgcacatatacccctgaacctaaaagtttttttaaaaaaaatgggcaaaagacctcaagctggaagccatcattctcagcaaactaacacagaaacagaaaaccaaataccccatgttctcactcataagtgggagttgaacagtgagaacacatgggcacagagaggggaacatcacatactggggcatgtcagtgggtgggggccaaggagagggagagcattaggacaaatatctaatgcatgcagggcttaaaacctaggttgataggtgcagcaaaccaccatggcacatgtatacctgtgtaacatttacatagacatttctcaagggaagacataaaggacacattttaaaagccctaataaaattattagttcagcttccagttattccttattattggtcttgctttaaccttgtacccaggtttctacaactaggccacctccttgctttctagtttcaacaaataagcccgtcttatcctgctctgttaacatgatagagtgggttttttaccacaaaaaaaaaaaaaaaaaaaggagtataccagtatcctatccttgtgtaatgaattactacagatttaggagcttaaaactacacatttattgtctcacatttttccatgtctcaggagtttgggtactggttagctgaaatctcttctcaatatctcatcaggtagaaatcaaagagatggctgaggctatgatttctttttttcttttttgaaacggagtcttgctctgtcacccaggctaaagtgcagtggcacgatcccggctcatggcaacctccacctctcaggttcaagcaattctcctgccttagcctcccaagtagctgggactacaggcatgcactaccatgcccggctttttttttttttttttttttgtacttttagtagagacagggtttcgccacattggccaggctggtctcgcattcctgacctcaggtgatccacctacctcggcctcccaagtggtgggattataggaatgagccaccatgccaggcctaggatttcatttgaagtttcaggtcctcttccaagagtactgttgttgaaaggagttatggtgtgtgtgtgagtgtgtgtgtgtgtgtgcgacagtatgactgtcttcttgctagctgttggttggcaaactctctaactcctagaggccacacacacttagggccttgccactcctctcacaatctgatcacttgcttcttcaaagccagcaagatactgtttgctgctgaatcttgtctcttttacgggtttgcctgattaggtcaggcccaccaagaattatcttcctttaatttgaaattttaacttgaagtcaactcattagaaccttaattacatctgtaaaatcttttgtaccatatgacataatctaatcacaggagtgatatttcatatttactaatcacatttacattcaaaaggagaagattatacagagcacataaaccagaaggcaggaatttgggtggctaccttggaattttgctgactgcagaagggaaatgaagccaatttcatttggctgtcatgagcatctaagatgttgaatatatggtgcctgaaatagtgtgggagcatagctgatacgccacggatgcagattattactcctacatcatctgagcctctgccatagttccttgtttggtaccctcgaagacttaaaaaaccagagtaaagtcttcttttttattttttcattttatttttatttatttattcatcctactgtaagttctgggatacatgtgcagaacgtgcaggtctgttacatagttatacatgtgccatggtggtttgctgcacctaccaacccatcatctaggttttaagccccgcatgcattaggtcctaatgctccccctccccttggcccccaccccctgacatgccccggtgtgtgatgttcccctctctgtgtccatgtgttctcactgttcaactcccacttatgagtaagaacacggggtatttggttttctgtttctgtgttagtttgctaagaatgatggcttccagcttcatccatgtcccttttaaaaaaaatttttttttttttagatggagtctagctctgccacccaggctggagtgcaatggcacgatcttggctcactgcaacctctgcctcccaggttcaagcaattctcctgcctcagcctcctgagtagctgggattacaggtccccaccaccacgcccagctaaattttttttgtatttttagtagagacgtggtttcaccatgttggccaggctggtcttgaactcctgacctcaggtgatccctccgcctcggcttccctaagtgctggaattatgggcgtgagccaccacacccatccgagaaccagagaaaagtcttctatatgactacatccatatcagagttcccttaccaagcaccagacttaccagctaggagacacttggaactcctcccttcccccagtcattaaaacacaccttgaagaatttctgctataggaatttatactgtcaaggctgtggttcgcatttctagtgggattctgtctcttagctattcttttttttcccaatatccttaaatgtaagaagggcttccatttaggagggtcttagccttctctatttctgtggttatccttgcatgaaaacttggcatatatttgagtgatgtcatgctcaaagttggaagctgcaggcatcagactttaccaaaatagctattcaattggtaaagaactatcagaatcaactattttgcaactctagagtctatttgaacccttgagtatccaagaaagcgtatgaagaagaaatatattggtaaatttcagtgaattttggcattttgaataaaagctactattccacaacctctagcccaatttcagggaactgtggggatggcagacaatattcctattgaagctggtaggtgccaggacaggaagtaagaacgttatcctctaaaaattggagttgcatgttttgatctgcctgttcagtggagaaccagcgtggaggctgactgtcattttaactgccttaggctgaatcagaatccctggcctctattgaaaaaatttaaagagacgagacatatttttaaaattttcttattggatcaagcacttaagaaatctctgtcaagtcatcggctggccttggagaagatgggacaaagactacagtaaccacacataagcatgaatataatcgttgtaaaaattgccttgcaagttattaaagatgacaggagctctcaatgagtaacaatgacaacttctggagaaaaaaaatatggcatccagaatttgaacattataaattacagtgtctagttttcaacaaataattctaaagtatacaaaggaaaaggaaatcatgacccattcacagagaaataaacagaagaaattgacacaaactattcctgaggatacccagacattgggctcattagacagactttaaattaaatgtcttaaatatgcttaaagaccttaaaaaaaaacacagaaaataactaaaagtggggggagtagaaccatgaattaacaactagggaatatcaacaaaggaatggacattagtttaaaaggaccaaatagaaatcctgaagcttttgcgatataatagctgaaattaaaaaatgcacaagtggagtttaatggtctatttcagcagatagaagaaagaatcagtgaactcaaagacagggcaactgaaatgattcagtctgtggaaaagaaagaacagagaataaagaaaaataatcagagtctaagaaacatatgagacaccatcaggcacaccagcttattatggattatggacattccagaaggagaagaaagacaaacattgagacaaatgtatgtaaaaaataatggctgaaaacttccaaaatttgaagaaagacatgaatctacacatacaggaagctaagtgaaatctaagcaggataaattcagatattcacaccaagacacagtataatcaaactgtcacaagccaaagccaaaaaaagaatcttgaaagcagaaggagagaattaacttgctatacaaaagagatttccaataagattaacagctgatttctcatcagaaaccacacaggcaagaaggtagtaggatgatgtgctcaaacaaacaaacaaaaaaacactgcctaacaagaattctatgcttggtaactttaaaaatgaaggagaaattaagacattctcagataaacaagagctaagggagtttgttgctagaagatacccttactctataagaaatgctgaagagagtttttcagaatgaaacaaaagatatcagatagtaactcaaagctatataaagaaataaagatcactggtaaaggtaactatataatacataggtaaatataaaagctaatatttttccgtttttgtttcttgtgtgattaaaacttgtagaaaacaattactatcccagctactcaagaggctgaggcagacaactgcttgaacccgggaggcagaggttgcagtgagccaagattattacaccactgcactccagcctggtgacgaagtgagactccatctcaaaaaaaaaatctcaaaccaaaaacctaactttacactttaaggaacttaaaaaaaagaaaagtaaattaggcccatagttagcataaggaaaaaataagaattatgtcagagataaacaaaatgaacaataagaaaattataagaagaaccaaaaagttggtgctttgaaatagaaacaaaactggcaaatctcaggctagactgacaaagaaaaaataaagaaaagtcacaagtaactaaaatcagaaatgacggtggggactagtttctgctgacattacataaatagaagagatttcaagagaatactacaaaaaattgtacactaacaaattatgtaacctagagaaatttctagatacacagaagtcaccaaaactgattcaagaaggaatagaaaatcttaaaaacctacaacaagtacagaaattagttagtaactgaaaatctcccaataaagaaaagtccaggaccaaatgatttcactggtgaattcaattaaacatttaaggaagatttaataccaattctgcttaagtcttccaaaaactagaaaaggaaaatcttcctaatacattctatgaagtcagcattactctgataccaaaaccaggcaaaaatgccaagagaacactaaactatagagaaatattcctgaagaatactaatacaaaactgcttaaaaaaagaaaaacttgaaaactcgattcaggagcatattaaaggattatacatcatgaccaagtgagatttatcccagtcatgcaagggtgattaaacaaaaagaaatcagttgatgtattatactaaattaataaaatgaaggaaaaatgatcttaattaatgcagaaaaagcatttaacaaaattcaacacctttatgtgataaaaacactcagcaaactagaaacagaaaaagaactttcataatatgataaaggatgtttatggaaaatgccctttatccacaactagccatttcactccttgaagaaagactgaaatctttccccctgatatcagaaacaagtgtgctcacttttcaccactgctatggaacattgtactggaagtcctatctatagtaattaggcaagaaaaataaaaatcatccaaattggaaataaaagcaaaatatctctatttgcaaatgacatgattctatctgtagagtaccacagagtatacaccacaaaactaatagatctaataaacacattcaacaaagttgcacggcacaagatcaacactcaacaatccactaatataccagcaatgaatcaatgtgaaaaggtaaataaaacaatattatttacagtagtacctaaaagaatacctatatacctagaaatacatttaaccaggaaagtaaaagaaatgaaaccaagaaagtgaaagtatatactgaaaactacaaaacattgctaaaagaaattcaagaagacctaaataatagaaagacatctcatgttcatcgattggaatacaatattgttaagatattaatattccctaagcaatctacaaattcaatgcaagtgttataaagatattaatggcccttttacataaatagaaaagcagcccttcacatttatatggagatgtgtagccaaaacaatattgaaaaacaaaacaatggtggaggactcacacttcccaatttcttagatgcaataatcaaaacaatgtcatactggcataaagacagacatacaaccaatgaaaataaaagtaaaaatctagaaataaacccaagtatctacaatgaccactttagttcaacaaacctgtcaaggtcattctttggaggaaaataatctcttcaagaaatggtgctggtgtggccgagcacggtggctcacacctgtaatcccagctctttgggaggctgaggcaggtggatcaggaggtcagaagatcaagaccatcctggctaacacagtgaaactgcgtctctactaaaaatacaaaaaattagctgggtgtggtggtgggaacctgtagccacagctactcgggagactgaggcaggagaatggtgtgaacccagcaggcggaggttgcaaattgagccgagatcgcaccactgcactccagcctgggcgacagagtgagactccgtttcaaaaaaaaaaagaaatggtgctggggcatttggatgtaaacatccaaaggaatgaagctgaacttgaactacctccatatacaaaagtctactcaggataggtcaatgtcataagtataagagctaaaactataacatcactaggacaaaacctaggggttaatattcaagaccttggacttatgggacacataaagattcttaggtttttacataaaagaacaagcagcaaaagaaagttgataaatcgcaccttatcaaaattaaaaacatttgtgcatcaaagaacattgatagtgaaaaagcaagagagaaaatatttgaaaatcatacatctgatagaggtttagcataatacagaatatataaagaatgcttacaattcaaacaccaaaagataactcaattaaagatgagcaaaggtctggtttgtttgtttgttttgttttattttgagacgtaatatcattcttgttgcccaggctggagtgcaatggtgcaatcccggctcactgcaacctccacctccccaggttccagtgattctcctacctcagcctcccaaatagttggggttacaggtgcccacaaccaagcccagataatttttgtgtatttttattagagatggggtttcaccattttggccaggctggtctcaaactcttgacctcaggtaatcctcccacctcagcctccccaagtgctgggattacagacatgagccatcatgcttggccaggcaaaagtctttaatggggatttctccaatgctatacaaatggccaagatacacatgaaaagatgtccatcgctggtcagtaaaaaatgcacatgcctgtaaccccagcactttgggaggccaaggcaggaggactgctggagtccaggagttcaagaccagcctgagaaacatagtgagacccacctctacaaaaaattttttaaaattagccaggcatggtggtgcatatttgtgggcccagctactcaggaagctgaggcaagaggattacttgagcccaggagtgaactatgactaagctgcataactaagctgcagtgaactatgaccacgccattatactccagtctgggtgacagagcatgacccatctctacacttcacaaccactaggatgtttataacgataatttttaaacatgaaaagtaactagtgctgcacaagaaatggagacatagaaatcctcaagcactgcctgtggaaatctaaaatgatgcagtatttatgacagtttggtggttcctcaaaagttaaacatagaattacattacaacccagcaattttacttctcaatgtatacctaaaagaattgaaaacgtacgcaaatagctgtacatgaatattcatagcatcacaatttacaatagccaaaggcggaaaaaactaagtgtctattaacagataaatggcgaaatgaactgcggaacatatattcagtaaaatattcagtcatgaggaatgaagtactgatacgtgctacaactttcattaacactgaaaacattacaataagtaaaagacgatagacataaaaggtcacatattgtgtaattccttttatatggcatatccagaataagcaaatactagagactgaaagcagatttgtggttgccagggatggggaaaggggaaaatgggtagtggttacttaatgggtgagggggtgttcttccgggatgataaaacagcttgtgactagagagatgtattggtatataacactgaattcatcaaataccactaaactgtatattctacaatgattaattgcttattatgtgaatttcacctcaatgaaagcaaattttgcaaatttggggtactatatgtttatactaagtgagtcaacataatacgatgtctgagagcttgggctctggaatccaccataccaatgctcaactcctgtgtgccttttgaaagattacctctcttatcctcgctttcttgatttattaaaataatatttctaccctcaagattgtcttaagagttagaagagataatacagataaagagatacacacacgtcctgatatgtagcaaggatttattaaatgtctgtttctctttttacctctctctagggagaccatgaagataagaggagtgtggacactgaccctggtctcctggtgaaagtcctgtggaggcaatccagctctgctctaagtattaggagtgcattagcttctttttgtttagtgttcttcttggaccaatcttgtctttatgtggaaatactaaacacaaagcagtaagattccatgttgtacctaaaggaaaatgcacaaatttgtccactgtacctactttggttctccagccttaggaaaaatgtactctccatgtagttagactagaacaccacactacgttcttttcagcctctctctctcgctctctctcctctctccataaggctgtgtgttgaagataaaagaatttagaaattaaggtccacactctctgcagacctccttatattatttgttcctctggtcctcagaaagacaacagtggttcctcaggtccccaggagagacctagtttagtttatccatcgccaactaaatcttctttatagaatatacagttgtctctcagcatccatggaggattggtctgaggacccctctagtataccaaaatccacagatgctcaaatctctgatataaaatagtatatttgcatataacctatgcacattctctcctcatactttaaatcatctctagattacttataacacttcatacagtaaagatgatatgtaaatagtctttatactatgttttcatagaatcatgacaagaaaaaacgttgtactgtacaggttcactacagacccaaccatccatttcttaaaaatattttcaattcttggttggttgaatccacagattcagaatccatgaatacagaaactcaactatacttggaacgaatgtggtgatattaaaagtctgttaagactttttttttttttttttaaatgcagtcttgctttctcacccagggtggagcgcaatggtgtgagctcagctcactgcaacctccacctcctaggttcaagcaattctcctacctcagcttctcaactagctaggattgcaggcctgcaccgtgtccagaatttgttccttctggtgggttcatggtctggctgacttcaagaatgaagccgcagaccttcaggtgagtgttacagctcttaaaggtggcgagggcccaaaaaatgagcagcagtaagattaattgtgaagagtaaaaaaaacaaagctccatgaaagagaaccggtaccggttgctgccgctggctggggcggtcaacttttattgccttatttgtccctgcccatgtcctgctgattggtccattttacagagtgctgattggtccattttacaaacgtccagctagccacagagcactgattggtgcattttacaaacctctagctagccacagagcaaccattggtgtgtttttacagagcactgattgattggtgcattttacaaaccacgtggaagaaaagttcttcaagtcctcacccgacacagaagtccagctggcttcacctctcaccaccatgcctagctaatttttgtatgtttagtagagacaggctttccccatgttggccaggctggtctcaaactcctgacctcaggtgatctgcctgcctcagcctcccacagtgctgggattacaggcatgagccaccgcactggccaacttttcttgaaaatctctcattttttgaaactccatctagttctcagagactcagatctctctgatcttattattccagcacttcaacatgtgtggtttcttttttatggtgggggagtggcgaagtctcgctcttatcccccaggctggagtgcaatggctcgatctccgctcacagcaacctccacctccagggttcaagcaattctcttgcctcaacctccagagtagctgggattacaggcacctgccaccacgcccggctaatttttgtatatttagtagagacggggtttcaccatgttggccaggctggtctccatctcctgacctcaggtgatccgcctgccttggcctcccaaagtgctgggattacaggcgtgagccaccgcgcccggccgtggtttctgaggtttccacgacagaggaagagttgccagagttgcaatattcttaactgcttcatgccagaagagacatatatccttctcttcagagtccattgacaataactaagcacaccgcctgtcctaaaagcaggggaatccagggagtgtagaggagaacatggagtatttggtagcccttgtctttgccaaactccttatcctcattcagcaaaattaggattaaagctgaatttgatggtgaggtcttcatggatgcaatagtccactaattttgtacctatttaattgtcctccatctgagtggactgaaggagactcacatactaggctactggcaatttggccagcacaacaggtgcaccaggttcctcctaaggtggaaaaatttgggtcaaaattaatgataaatgaaaaaaaaagagataatacctgaatgcaaagtgtggaatatatggacactgttgaagggaatatccagcactatatcagtgccttgagagttcctcagagcaagagaataatgttttctctcagcttaaattccagatgttcagagggggacgtaatacttttgctaacgttgcaccaattctgaaatcttactaagtagaaaggcaaccagcatccctaagtgccatctctccaggggacacatttctcccatgttgtgctaaagaaaaaggaacaattcctgatgagtaagcaggactctttttttttcttccaatgcaaaacattttaataggtagtcaaatatacagttattagaattatgtaaatatcacgtataaaaattggtataacacattagatgattctatgaaataaaaacacaaatcacacattgacaataacccctgcagtccaaatacacccccacaatacgacaaattacaaacacatttaaaaaaaaaaccctacagacatttatacatttaacaaagtaactgtgactagactaaatacattcattcatcaagtacaataaatttagcattgctgcttatagtcactaataacacaattttaggtgcaatttcacatgctttcataaatcttccagtacagttcccatagtaaagtgtctttgtgcacaccatttccatttatctgcaggtgcatcatacatcatacttaaaactatttcacttcaccaactgttaatatatattttaagtggagagcaggtaaaaaatttaaacctcaatgatgacaaaatttaaaattaaagaaaagtcttgaaagcctacagtgatttgtttacttgcataagtaatattttcacttagtacaggctattaaaataagtaatgagaatttaaatattaactcaaaaaaagatagaggctccaaacttttctaagaaattaatgcattttcaatataatcagtctgtaagtcaaaagtaattccatattcattgccaaatttaaaataccagtgatgtgaagactgaggcctaaaactgttgtgctaaattgtaaaatacagtaaagaagatgcagctcatttgcttgggaatatgtaatggaatgttttccacagtaatgtttatgttaaacattactttaaatgggcagtctaaataaacatacctttgccagcaaggaaagtgaaaaattaaggcttttctatgctatctgtaactactacccaaacttaaatagaggttacaatactgcaaaatattacttctaacttcaactattgttggctgcttcatttcaaccttattatcttatttacatgcctatttttctatatctctatttcaattaagtccccaatcccaccctatccaaagagaatgctgaaaatggttaggcccttacctgtttggttcacagttgtaatactgggggctaaaaatgcttaacacatggcataaatccaagaaatacctttgaatgaactagaagcctggcctccaaaggcaaccccacttgtttttccaaagcattaacagataattgttacctctttagataaccagattgacaattattaaaaaggaatcggtgtttcctaggctatgaaaacatcaaaaacatgtaatagaaagggtaacttagggtacaaacgtatcaaatcaaagctaaaggcactggagaaagaaggtaagcattgtaaacaatttttaaagcaaatcaagttttaaagtataaaacgccaagctactaagagaaaatgtattaaaatgatgacaatgttttactatagtggacacaattcctgtaatttcgcaaacagaattctttcgttgttctatcgttttctttcatcctacatcttctataatattccaacccctaaaaacaaatgcattttcagctgtgtgaaacaaaaaaatgcaactgaagtatctatggaaattcctttctcttaaatgatgttataaatttgatacataaacttgatagacataagaacatcatcttggaaatcataaaatactaaattatgctcaatcgaaatacaaaggttcttattcagttgaacagtttagagccccataagaacaaattgtagtgtaaagaggaaaagtaagtacaatctttccagacacacaaaacaaagaataatgaatactgagttgaaataccacaagctccacattagagccatttaatatacacattttcataactgtttcttgaaaaactatttaggtaaaatatttagaatttatcatttattttaatttatttgaatctatgcaatgtccatccatattaaaatatcaattaaatactttattataaaactattatacaatttaaatttttattagaaaaaggtattattcacatccacaatttcttaaagtcctttttaaatacgtgtattccataagaaacacactaaaatcattacttatgtttcataggggaaaaaactgtaaggatcctattaacccaaactatatccgtattatgcttatttcttaagcatttacatgttcaaatatgtttggtgagtagtgatcattcatccccacagtggtaaatttcagcacaatattaagtgactgagagagactaaaatagtcacatgtagattacataaacagatacttattctgttatacctaagcttacttataaagcaacataaaatgagcattggataacaatgataacaaatgtaaacaaacagaattaaatattaatcccttccctgaaaaacaacagataaaagggcttcttgctttattaaaaataaaacatgatctattgtatcaaaaaggtaagacactgattttacaaaattatatttccaaatacagataaaaaaaagttgaacagttaattcagattttattgagctaaaatgtgcaaaaaatctgataatacttaagtttatttaattcattgtgcataggttgataatatcccatccaaaaaaagcctcagtatcttgttaagactcaaaatagtatttaattatctgagcttaagatttattgaaccactatccaaataacaacaaaagtccatattgtaaaagaaagaagtgaaactaaaaattttctgattgttaattatgacttgaaattcattcattcataaaactatagccaatattcatttgaaaagtgaagaaaaattggaagtccctatgataaatacatcaattctaaataaaaaattaaaatcaaatttttctattacaaaatgcacatgatcggtttttttttttggatggagtctcgctctgtcgcccaggctggagtgcagtggcgcgatttcagctcactacaagctccgcctcccgggtccacgtgattctcctgcctcagcctcctgagtagctgggactacaggcacctgccaccgcgcccggcctatttttcgtatttttagtagagatgggctttcactgtgttagccaggatggtctcgatctcctgacctcgtgatctgcctgcctcggcctcccaaagtgctgggattacaggcgtgagccaccacacccggccaaaatgcacatgatcttttaaattattcaagtttaatagatttactaaggatagagttcatagagcatttatttggttcttctgtttggactcaggtatttgcaaaacacccccagagaaggttgagaaggtaaaataaagataaaattgtgataattttctccacaccacaacaaaggtactcagatttaaaaattcaatttgtaactctagaagaaaaataggagaaacaatttacatccccaaaataattttccagaaatatgacaaaacgtataactccctagaaatgttattagtgaatcaaagtgcaagtaatgacaacattcacgtcatatgtatttgaagactcaaatgttttaaatgttttcaatgacaaataactggttgatttttttttaaggtggtgggtgggaaacaaagataatacaaatctaatttttccaggaactgtagtactgtccctgtccccatgaaattaagttataatttcactgttcaaaataatataaaactattttgaacaagagtgaaatagaagcatgaatttagatacgcaccaaaccctatatgacggactaatttacacatagtatttttgataacaacctaattagatattatctttcattgtttactataattccgagaaactgcttttaacaacatacatttacactaccacttaactaaatggggacatataaatacataaatttttaaagaaaacaattcaagttatttagaggagaaataaaacttcaattatttactttttaaagctgcatttagataaaaagttatatggtttatgatacttttcacaatgttataaatttatattccaattttctcataaatgaaagattgtaaagaaaaatattttgttccttgaaaataacctctctcttcccctaaccccagtaaggacaattagtgtgcccttaatttcgagactttgttgttgtcatccacatcaactgtctttttcatgaagtataatattttgagagagagatgtaaaaattaaagagaaaacctgcttttggaatgcagcaattctaaatcatttcactaagaagcaccctttgatatgctggtccgaacttttaatataaaacctaaacaccacttatttctgaagtagaattttcaccagttttagtaacttcatacatagcaatactaagaacaacaacctgtgctttcgagatcttggtaggtgttctaataatggaatattttagatatggctcattgtcaaggctgggtggacagagttggacatgaattggctacagaaagctaactaaacacttagtgactgaataatgatttgcattttgcttgagccaaaaaagatgtttaagccatgtaccaccacattccctgcttaacattcctaagtttctttattcttcatagctttctaatgaacaaataattagttttcctgagaaagagtataaaaaagttaacctttcttccaaaagtataaagacaaataaaatgttgactcacaatacaaattttttacatagcattaaaggtgcagagatattgactgctcctcttcattatgattggcccaccccttaaaaagactgcaacagaggattcaattgtctaaaatacttcgaagtacagaaattaaatgctttagcccataaatatatccctcatctattgtgctgctagggaacacatgagcaaaatctatcattcgcactcctacttcagcaatctcttggcaaccagtgggaagatggtagaaaactttttccagttgggaaagtacatttccatttaaatgttctgtgacatgcttttccactcattgtcttgctccagattttcaactttcattgaagtctgactgtgatggtttttgtatacattttcctgtgacgagcatacatcttggacaagtttttgcccacttaagcctctatttttccattcactgtggaacttaatacatgaaagttattattgtactctagtacctctgtgtctgacagttgtcctttggacaaaaacttttctgccaaagttctgtcattcaattttgtagtggttggctgagatgaactttcataaaccaatagtaatgaacttgcataaaagttaagctgcttctggttttcaaaccactgcagaattttctcaatcttctgaatactggcagcaacagcatcttttcttaagcagtacccattatgaaaaaatccggagactccatcctttgtagttccttttgttaagcttcttccataatgctggttttgtatatcatagctatcggaatgaacatggtaaaccctcatgccaagcaccaagaaacccaatctcttccattaatgggtacttgctgaatcttctcagatgaggcaaaaggatcatagcttttttgccctatctttatattcattatacagggcttattaaatttatgtgtcacatcttccagttttaggtataaatcgtttggtgcagtgggaggtgaccagatgccatattttggcaaatattttcgtagctctagaagaacaccatcagaacagtcagcagcataaaccgtatgctctcttgggccccttggaggtggttgtaactgtttcaaagctgtgccatctgagtgttgcagtatacccactttgtccttcccgttcatgtgtccggccacctgatacgagaggggcacttagccgttgaggaggcggagtctgccgcccgccggctgcccggtgccctcagggatggcctcgatcgccggtggggcccgcatttccggggggctggcgcctcgacccggaggggtgatggtggctcttttgccataaccgagagcagaagcggtagcggtagcgagagcaggaaaaaaatagggcgagggagggggcgccggagaacccgagggtcgctcaggctcgggcgcgaggaggcccgggggttcccgcggctggtgcccgctgaggccccgagagggggcccatgacaaccaggggagggggggcgtctgcccaactcttggcggagcgcggctcccggctccggctcctgtgcagccgcaggccccggcgctgcccagtagacagactaagcaggactctcttaatgtcccttaagtcttttggttcttgttttacaggacatatcaattagattgcaattaaggagggatctcggagagtttctcccttctggcagctatgatgtacagtcatatcaggcaggcagactaatcattgtgtcattaatctgatggccaaatgcttaggttcctgagtataatggaaaacaaatagtggcagctatctcctagtgtaatgtataaaagaacttaaacctttgtctttatggatggacagatgtcacacaagattaaaacaaaaaattacttcagatgctgataaagcattgggctcacatcccaactgaagttaactctgcagcgagacaatggggggttatgggaagctttgtggcacactaaaatgtgtatgaatgaccactacacatttgaccttagtatagaggacccgacaatttggggtacaaagtatgtatttttattgttcccaggcaattagcactcaacaacaacagcatgtgtagtggattaaaagacactgggcaacaagatgaaagagagctctttgtgaaataggtatgggtataggcatggtaagacaagcaaagttttccttcagtataaaggacattcaaaagaaaaagatcaatagcaaaaatagacaagttggaagaaattatgttcaaacagtaaagaacagaatctattgatgctgctatgatgtgaatgcttgtcccctcagaaactcctattgaaacttgatccccaatgtggcaatattgagagaaggggcctttaggagatgattgagtcatgaaggctctaccttcatgagtgaattcattcattcatagattaataggttaggccaggtgtgatgacacatggtggatggcttccagcactctgggaggcaaggcaggaggatcacttgaagctaggagttcgagaccagcctgggcaacaaagctagaccccacctctacaaaaacatacaaaaataagccaggtctggtggtatgtacctgtagtcccagctactggtgtggctgaaacaggaatattgcttgagcccaggagttcaagactgcagtaagctatgattgcaccactgcactccaagctgggtgacagagtaagaccccatctctaaacaaacaagcacaggttaataggctactggattaatggactgtcatgggagagggactggtggctttataagaagaggaagagaaacttgagctagcagattagcacactcagccacttcactatgtgatgcctgccttgggactctgcagagagttcccagcagcaggaaagctctcaccacatgcagccactcaaccttgaacttctggggactccagaactgtaagaaataaattcgttcgctttataaattacccagcctcagatttcagttatagcaacataaaacagactaagacagatgccctagtaaatcaggtcatagaaacccaatctaccatattagaaaatgacaaaacacaaaaaactcattatcggaaaagagcacacaagctagtccaacagagccttcaaatcatgtttcttgaaatggaggtcaaatgagtcataggcggtgacctaccgttttagttgcagcagaagctctagaagtacacttctgaaaaatacgtgatctcctgaacttatgaaaattttcttgaggcaaaggcaatttatatcaatgttccctaaatgctcttattccaagaataaaccaagacgtgacatattgtgtaaagaatataataaacaacacatgtatactccttgtggaatcaaggagagcttttttacatatgtaacaccagatgggaaccttgtatctgtgcaaacatactgacagaggctaagagattagctttgtaccagttagcctgaaatccagaagtaacagaatcataagacactggtaacaatcccagctcataataatatctagtatatgggtaaagtccaaatctactaacatgattttaataatgctataatgctcacccaattattttctaacaatacgaaagtatagcatagggctgggcgcggtggctcacgcctgtaatcccagcactttgggaggccgaggcaggctgatcacgaggtcaggagttcgagactatcctggctaacacggtgaaaccacgtctctactaaaaaaatacaaaaaattagccgcgcgtggtggcacgcgcctgtagtcccagctactcgggaggctgaggcaggagaatggcataaacccaggaggtggagcttgcagtgagccgagatcacgccactgcactccagcctgggcgacagagcaagactccatctcagataaataaataaatatataatagcactgtggctcatacctgtaatctcagcactttgggaggctgaggctggtggatcacaacgtcaggagttcgaaaccagcctggccaacaaggtgaaacccatctctactaaaaatataaaaattagctgggcgtggtggcactcacctgtagtcccagctactcgggaggctgaggcagaagaattgcttgaacccaggaggcggaggtagcagtgagctgagatcatgccgctgcactccagccagggcgacacagcaagactctgtctcaaaaaaaaaataataataacataataatactccaatatggtgtaaaattgggattattggtaaaatttggctatcttatataaatgcatcaaatgatagtactaatgttgagtgaatatactgagaaattgagttaaaacttccttgggttgtaatatcaatagagacactaattggcctgaggaagaatgagatttaattaatcaattaatcactataataggtgtttctgcagagttttctcataaagtaagatagccatagataagtaaaaatcaataattaagtttatataacagtaaaaagaaatatgttgtggaacattgaatttaacagattatttctttaagtctgccccccttcctcactaacttctgcaaatgatgcatgtatttgcattaccattcctgttttaccctataaataaatggtacactacatgtagatttaatagtgttataaataatttctttgtaaggtgaaactgactaagggtcagaggtaaactgcaaggaataaaataactcagcaggtctgttttatcatttttgcttctttctgtagccattgtaatgcctcctggctaagtgctgagaaccaagtcccggcatgtgcacatggtaactggttaatgatattattctgcatgcccaaggcagtggtcaggatgcatcagactgtcagcattatgtaaggtaaacctgaaggttcatgatgtgatcctgatgcctggtttgggacactattgctggtcatgtaaccatgtgaccagtatggatcacaaggatcaagtgagcttcccaaagttgagacatcttggacatgacttttctgtttgcagctggaaccctcatatgctggtccatgcaagcctcatatgttgagtcgcgtaatttctccagtgaatcaccaaatttgtgagtagttatatgacttccctaaacaatcaaaggatctgcattaaacctataaagtctttcactaaattccctcaacatttctgacccagcaccatagctgtggatgtttcagtggtatttacatataacccaaagtacattcctaaagaaagtagccatttttatctttttcagcaagatatagttgaatccatctaatatcaccattgccactacaagtaagctatcattaaaaatctttgctattttagccaaaaataaaataaaataaaataggcgagatgaaatattttttcaaatagttatttgccatttttattcacattttggttaaattgtataatttttgttctttatcttagcagtacttttttatatatttaaacaaattcaatattttgcctgtcatcttagttgcaaataatttcctagcttcctagatcagaaattttgctacaacaaatacaatcctttactccaataatatattttacttggttattactaacatataaaaagtattgtctttatgtacttatttagaaattatattaaagttttcgatggattcaagtggattctcactagattctaacagttgtttcccaggcagtactcagtaaagtttaaaatgatcatttctcccttattcatgtccaggttaaataataattattcctaactttaaaagtgtctgctagtatttcttatttaagaatgttatcaggtttaaaattgagatgttataaagaatatttaggtcaggcacggtggctcatgcctgtaatcccagcactttgggatgtcgaggcgggcagatcacgaggtcagaagttcaagaccagcctggccaacatggtgaaccccgtctctactaaaaatacaaaaattagccaggcatggtgacgggagcctgtaatcccaaaaaaagaatatatgataagtttgatttaatgacttcagaagatatttacatagtgatgcactatttctcatttgacagttggtgtgaaatcccgaaagtctgttctcactctgcacagtaagtagtgcaggactgtaagaataatccatgctgaaatcatgcaaaccaatcttttttttttttttttttttttttgagagggagtcttgctctgtcgcccaggccggagtgcagtgaggcaatctcggctcactgcaagctccgcctgccgggttcatgccattctcttgcctcaacctcccgagtatctgggactactggcgcacaccaccaggcccggctaatttttttgtatttttagtagagactgggtttcatcgtgttagccaggatggtcttgatctcctgacctcgtgatccaccagcctccgcctcccaaagtgctgggattacaggcgtgagccaccacgcccggccgcaaaccaatcttattaactaatgggaagattatgattattctagggccttaaaacttttgtgaatatattgaaaagaatctgttgctgtcagctactaacacacattactaaagctaagtttatttagtacactataatttaagaattggaaatgttgatgattgaagtgtttcattgctttatttaaaacttccaaagaaaagtttgaatggtgtttgccttcctctcctcctcatataacttttgctatggagtgctcatcttttctatgcctgggtttattgtcacgctccacgctcctttctaagtctggatcagatgctcacatttaatcctttgcatctttggtcatgcagtatttctgaaagccctgtaatgtgaagcgatgtttcgccaatgtcacttactctgggacatctttgtcctttatatcataacctctctcctcctttgtactgataagctcaccttcactaagttcctctggctgcgtatctagtgtcagtagtgtcagccccatggtcagttgtttcttctgtaactccatttacttttgtttcaacttttacttccagcattacctcttttcatttcattttacttttatcttcactgttcaactctcttttcccattgtccacttacttttacattcagagagcagattcttttgactcgacagagtctcactctgctgcccagactggagtgcaatggcgcgatctcggctcactgcaacctccgtctcccgagttcaagtgattctcctgcctcagcctccagagtagctgggaatacaggcgcacgccgccacgcccagctaattttttacattttagtagagacgtggtttcaccatgttagccaggctggtctcgaactcctgagatcaggcgatccaccctcggcctcccaaagtactaggattactacagccgtgagccatcgcgcccagcctttttcattgtttattcagcaatttttcatatttataagtaacatcaggcactacttttttcagtagcttgttttttctactttcatgtgccattgacgttagaaaacttgatgaaatggaacagaggagcttcatgctttctacgtttctgaacaacaagtcgtacatctgggaaataacttttttttttttttttttttggcggggcgggtggggacagggaacggagtttcactcttgtcgcccaggctggagtgaaatggctcaatctcagctcactgcaacctccacctgccgggctcaagcaagtatcctgcctcagcctcccaaggagctgggattataggcgcccgccaccacgcccagctaatttttgtattttatatttatatttataaatatatatatatttttatttatatttatatttataaattttgtattttagtagagacagggttttaccatgctgctcaggctggtctccaactcctgacccgcccacctcggcctctcaaagtgctgggattacaggcgtgagccaccatgcccggcttggaaataactttttttctttaagtgttttaaaatgaactcacatgaccctttttactagtaggtgctggattgcccagcttcctttagctgttgttaatattatcaccctcgatttctttcagttaacatttgcttggtcattgctattgattatattcttattattatgcttcatgtttgttgtaaagagcatatacttgaattctgtgtgcatacgggtgtttgcgttttaattctatctgagtcgtttcaggatgactctttcaatttgatcttgcttatgtcattttctcttatgatttctaaatttacgtttcctttctagtctattttattttcttcctgaatgatgttgtttgctattttttttcaatcatgtggatgatatataacctgctataaacccaataatggttctcctgccatttaaaaagacatttgtaaactgctttcctgtgtgttagtttaattttttcatcattcattttggtattaaaagttgacaaagcattaaataaaatgtgaacaaatatgtaagggcaaataatctcaaaatataggagctatagtttggtagtcacataaaaaaggctgccagatttagataagatcatgtaattattttctacttgaatggtttctgtagttaggtgtcccattttcctgtcttacttaaaataaggggaaagaaaggcaacagcagtagttgatcatgaagattcatgatcttttcaaagacatcgactccctacaaaacagaaaaaggagtctacagagactgtctttgcaaataattatctttgcgcagatgtttctgtacttagacgtactccttttcatcattagtttccaatttactatagggaagttgtctttccagaatattttacatttctttatttcttcatttccttttttcctttcttctcttctttttttttttttttctttttggtatagggtattaaatctagaaggtatctcagagaatatctagtttaaccccttagaaagtcgatgtgacttgtcaaagtcactgacattcagtaacagaagtagcatttgagcactggtgtccaggtttcccgcacatcagtcctgtgctcttcccatcacagttccttgtcttccctgtctttcatgttttgtttctttcatactcagaataaataacacagtattttcccatttaattgtctggatcgcctcaacacaattctaggggctcctaatctgaatggcttcattccatagattgtgaaactaaaccaaacgcacacagacacacagtgaggtgcttagagtcagaggttgcatgggcacttactacactggagtgacaccgcaggcatttcctttctgatcactcagtccatagggtgataaccaataaatacgagcaaaaccagtataactgagattggcaagaagcctcctggactccaaaagtgtgactttaaagacagaaaatacattattttccctatggctagtaagattcagatatttttatgagccatcagaggtacctttgtaggagtcctttagaaaatctttcaggctaacattattttgtataaaccaacactgataggtaatcaaagtgaaaaagggaggaacacacgttcctatctatggtttcattgatctcatcttacctctggccttcaccagtctaagtgatcatttcctcagactgacatgtccatcaccaaggcagtttctgtagtttgacatatgacctactgaagcaaaaatgccccagggtatactccaagtgaaaacagatagtgaataaataacgtggattccaaagcaagtagcatgaagtgttgaaaagttctctgtgccaattctttgacttttctctaaattctgaagaagttctaagttaacaattcatgattatccatgaaatgaattaatctgaaccctgttgacttttgtctgatgcaactgtgctttaattcttattttaattaacctgtagatgaagaacacataccagctcaaagctcatttcccaaatgaaacattgtttgagctggtgtgtgttaatttcccaaataaaacattgttgtttcactctttgagatgtcaaattaaattggttacaagaaaaaattctgactttgatcagtcctctatgccagccaggaacatttttattatagaaaatctgtatatgcagtgaagatgttgctttctcactgatacaagggcggagtagtcatcatcctttctgatgaaacacagatggtctctgcagagcccccattcatctttctgcaacagtgttgcaattattcagctaccttctcctgtcaccttctttgagaaagatcatccactccaaatactcttgctcccttttattggcacatattcagagccacatatgtgacatcttggacaaatacacccatcttaggaaaaaattttaacaggagtatgcagtagttagatctcctagaaaaactttttttgagttccatttatttctatcttgaaaataaaaacgatgtacttccaaaacagttgagaatatagaaaagcatagtggcagatagtaagtcacgtacaatcccatcagaaggggtaaatattattaatatttttacatattttatttcagtcttcattcatacatataatatgtctatttattaaacttcagcattcttttttgaacaatttatggataatttgccatatccttgtgtatatttctgaaacatgatgtttaattgctaataatactctactatacacttagccaatccttactggtttgtttttcatttttaacttttaaaagtaatattctgattaacaatgttgtgtataagtatttctctatgtttatgattaagttcttgaaataaattcctggaattacaattaagtcaagtaattaaatgttctcaagacagcataatataagaacctgtattttccaaatactcaccagtaaaagctattttaataagttaaatttgtttgacattccattcaatattaaaggattgaccttcaaatatttattgtccacttatattcttcctgtggacatctttttgttttgttttgtttttgagacggagtctcccactgtcacccaggctggagtgcagtggcgggatctcggctcactgcaagctctgcctcccgggttcacgccattctcctgcctcagcctcccgagtagctggaactgctggcgcccgccactatgactggctaattttttgtatttttagtagagacggggtttcaccgtgttagccaagatggtctcgagatcctgaccttgtgatccgcctgcctcggcctcccaaagtgcagcgtgagccaccgcgcccgtccgttttttccctttttttaaaaacacactttacttttacttccaggtgagtatttttaatactgttatatttttgtaaaatattataaaaatactgtaatagttttgtaaaatattttgtaaaaatttttaaatgaagctatttaacacatatgacatgctaatgttacttaatggattcctatgtatttcataggaatctcggcccagtccaggcgccgcgcgtggctggagctctggctggctgccttagtgtcatgcggaggcgtagcgaggattcagggacagtaagctctgttctcgccgagcagggggcgggctcgcgagatcagctgcttctggccgggcgggggcgtggactcagcgttctgggtggccaggccgtcgacctgcggcctttgttccgggccgctgccaggcctgaggccctcctgggtttcggttcagcgttagttaacagttaacccgccagggcaggcttctgcccaggcacaggagagccagtgagcttgttcaccttgaaacttgggccacacctgagacctgccacctcagggtggtaagcaggccgtttctaacaagctttcatggcatttgtgcgctttaaagtatagaagctgctccagggcttccgcagccccggccgtcctggagatactcgttccctggagtccgtagttgagaatttacagctcctggacagccacgtgcagtctcagaactgcaggcgtctttaccgaaatgttaaacacagcttgaagttaggcaggataactgccagagctggatggaccttagaggtgccagctaatgcgctgtgagcgttttctgaggttaggcctgctctaaacatttgatatgtgttaaggcatttatgtgctttgcccacacccctatgtggcgggcccttcttacagtaaaagaaactgcagcacagcgaaattaagcaacttgccccaaatcacgcagaactgggatgcaaacccaggtctagctcactcgtgatcacagttcaacatcagacgatgatgccaatttccagaacagctacgtgactttatataaaattattgggcaagcgttcaattgtaaacattcgtgaacatagctgttgcacattagctttcctatttttttttaaattcaggaccatgtttggtgacatatagatatcaatattatatatatcaccaatatacatctttgctttgctaaaaggtttttgtgtcttcaggatagtttacttgtaagccacatgtttttataaatccgtgggtgcaacctgaataaaactaatgcctaccccgtggcggttttgtgaagagtaatgaactattatattcaaagggtccaagcagtaggcacttactgaaggacagctagttttatctattattattctgccattcagagagatatcaaaactactctaaggcatttctcttccctgcacctaaaagcaagggtgtcatacttgagataagcattctgataatgtgtaggcaaagtttccagacttagtaaaagcagcttaatcatggctcaagaggagtgacaagttaccacctatctgcaattcaaggagaatataagatagagaagaaagcagtgaatgaatttcatttgattagcagtagattggacactctactggtcttgcctctctacaacctctcttccacctgacctctaaatgttgaagtgcttcaggaaatgtcttagaccttcttccttatctacacttcctctccaacatgaatcttgatggctctgcacaagatactgaaaagagggaatattcttctgtctgggtgggcagagaagatgacattaaaaaatctgaaagaataatagctgttgtccatgatagagaagtggtcattttctatcacaagggagaatatcatgctatggatattcgctgttaccactcaggaggacctttacatttgggagatatagaggattttgatggatgaccgtgtatagtttgccgctggcataaatacaaaattactttggcaacaggagaaggtctgtaccagactataaactctaaagatccatcagcaaaacccaagtagtgctccaaaggaataaagcaaaggattcacacagtgacagtagacaatgggaatatttatgtgactctttctaatgaactaatgactctgatttttatgccactggatacttcaaagtaattaagagttcttcctgataaaaaatacatagcaatgaaaaatattgtgtatgcttgaaaacatttttagaataactctgcttcagttttaaaagggatgaaatttttcaacataggcacaactatttaaaaatcatataaatttgagaggtttaagagcacacatacttagtatgatataaggattatcatcaggatcaatagaatacattttatcaaatcctctggattaattagaacctgaaggttataggtttggtatgttctgtttaagaaggatgaaaataaatttggagtaaacaaaataaataataggtaaaaattaaggtttagtaagaatttttttaattttaaaaatttaatttttaaaataggaaaaaatccctgtttgatgtagcagacttaattctggaaaagttttaatatatacaaagtaaatagactatataatgaacttccatcactcagctttaacagttatcagcattcttccattcttgttttatttatacctctatggattccctacctctcctatttgattgttatttttacatttttaggtaaagcttaaatacattgaaatgttcacatctgaactgtacaactttcccaaataacatagcagattttgtatacttaaaaaatgcctccaaaaatgagataattttacctgctgaacttgaaaataagaaacttaaccactgtgctagacatcaaaaccaaataagccttggcttagtttctctatgatcaaggcagatcgagcagtaaggaagccacacacacctgctgcccagccatgagagatgtaaagtctcctgttcaatgagtcaatgtactttgaatgcctatatgaaattttcaaataaaggttttttaaattttttttaaataaaaaaataggccaggcgcggtggcttacgcctgtaatcccagcactttgcaagcccgagacgggcagatcacgaggacagcagatggagaccatcctggctaacatgatgagaccccttctctactaaaaatacaaaaaaattagccgggcgtggtggcgggcacctgtagccccagctactcgggaggctgaggcaggagaatggcgtgaacccgggaggcggagcttgcagtgagccgagatcgcgccactgcactccagcctgggttaccgagcgagactccgtcgcaaaagaaataaataaataaaaataaaaataaataaatctcccacctgtgttaagacagttaaatatttcttgatgttagcttgaggaccaagtgagccatcttgccagttaagcaagtcttatttcagaggaccaaatggttaaaagaggagaatttgtacatttgttgagcttccccatctgaagcttgggttccgtactatcctattactatccatcttcatactgaatgaaacaaactgaaagggaattcataatcttttttcttaactgaacaggaaaacttatgaaaatcaacaataaatctgaattttaattttcattcaacagctgaaaaaccatgtctgttgaccacattggactattgcctagttaaaatccataaaattctctataaaccaatgaaaagaaagtagtctggcaataatttccaactttttaaatcctaatttttaggtcaggtgcaatgcctcacgcctgtaatcccagcactttgggaggcccaggcaggtggatcacgaggtcagaagatagagaccatcctggctaacatggtgaaaacccgtctctactaaaaatacaaaaaaaaaaaaaaaattacccgggtgtggtggcgggcacctgtagtctcagcaactctggaggctgaggcaggagaatggcgtgaacctgggagggggagcttgcagtgagccgagatcgtgccactgcagtccagtctgggcgacagagccagactccgtctcaaaaaaaaaaaaaaaaaaaaattctaatttttagttacaaagaaaaaggatagaacgaggcttttcaaggaattcttgctcatcccttcaataatttggtaggcaacacagtcctagaattcagcttcctttttggttttattactattaaatagatactttcatataaatggaaacatttttcctcaaaacatcaattcaaaacatactccttatattaatggctatggcaccacatttttggtaaattccctatgtgtaactttttcctgttggtatgtgatttttttcatttaatatgactatctgctggtgttgggggcaataggtttgtgaatattctgtggatatgtccatgcataggtgtatatatatacctatatttttccagctaatacctcaaatgtgtgattgtttaatatataccacactatgtttgcacagagcagggcttctattagcagtggatatttttatttcttttttttttttttttttttttgttttgagacggagtctctctctgttgcccaggctggagtgcagtggcgcgatctccgctcactgcaagctctgcctcccgggttcacgccattctcctacctcagcctcccgagtagctgggactacaggcgcccgccactacgcctggctaattttttgtattttttgtagagacagggtttcaccgtgttagccaggatggtctcgatctcctgacctcgtgatccacccgcctcggcctcccaaagtgctggaattacaggcatgagccaccacgcccagtggatatttttatttctaactttgaaaatcagtccacacaatttcattggtgtgaattctttctgttgctctttttcatattttaatgcagagattcctcttacaaggcccatgcttcaaacacaattatatctttctatatccagccagctggaaatatataggggtaagaagtatttcttgaaaagtccttgtttagtaagttagtaacaactgggatgactagttgccaagatgtcttgtaactgcctagcagatgacacctgccgtggcaagtctcattcacttcagtacaagactctgtacatttcaatctgatattctattttgccatttaagtacgccattaaaatcatagagattttcagtgacattggagtactgtaaatattagtttcaaaaagaattattttgaataggatgattaaaccaataagaagaaagaaacacacagaaatgatattttgcagtttatctgtattaagaaatgcttcttgccaatttctggttttggtttttggattgctacataagactttctttccatttactttatgtgtttttaaaagctgcaggtgatttttaaggtttgatggaattataatgggagccttgtataagttaaatgaaactggtaaaggagagcttactttgtctataatgctttcaggattataacttagatttaaaaatgaaatgtctgacttgtaaaatatttaatgttatatcagacttcaataaaattttctgcgagaactcaaagtaaatgcattagatttttaatgaatgttctgaatgaaatatgaatttttgtctttcagtctctgtagtttatctcaatatattaataaaaaggtctgttctcactgtaaaaaaaaattcatattataatgacatgaatatacagacttccaaattagttctttttatatctgtattttttaaacctcttgagttgggttatttttatttccatttcctggctcttctgccgcatgaaaatcatgcttccacttttcttgcaccctttgataagcctcaaagttactatatggggtacccgaaagacaagatattgtcactagcctcaaaaattttactattatggacacacagacaccaatggtttccctgtttctgaaagctcccagtttacacagatagaacttcatgctttatattctttatcagacttcacatagttgaaaattatttccttccaatctggaaaagatgatttttgagttgtaactgatcacaaattgctagtcagtctgtgtgttcatcctacggtttcaacatcttctaaactgtgtttatggtactagtcttaattcatttttatattaaaaacagtcattttcatcacacatacctgcatttcaaaattttttattagaagatgacacagtacaaggcagttgaacactaacttttgatattttgataaaaacaaaaatgggaatctttccaagtgacttttgagcaaggatctggtcatctatgtatttgataccagtcgctcaatattttaaggtaaatttaattgaagtatattacacatacataaatgtgcataaatcataagtgtaaatctcaatgaattttaaaaagaaaacacaacagaaaaacaccttagcattctctctaatgcctgcccctagtcataatccacaatccccctcctaaacagtaacaattattccttaattaccataaattatttttgtctgttttgaaatatttaggtaaatgcagttagataaatgtactctctttgtttaaggcctctttttataaacattgtatttgtggcatttattcatattttgtatgtggaaacagttcatttatttttactggtgaatagtatttttctcctgtgaaaacaccatagttgtattcctctgttctacttttggtgagcattttgtttgtttccaattttgatattttgattaagtctgtgatgaacattttcttttcttttttttttttttttttgagacggagtctcactctgtcgcccagactgaagcgcagtggcgggatctcagctcactgcaagctccgccttctgggttcatgccattctcctgcctcagcctcccaagtagctgggactacaggcgcccgccaccacactcggctaattttttttgtatttttagtagagacggggtttcaccatgttagccaggatggtctccatctcctgacctcatgatccgcccgcctcggcctcccaaagtgccgagattacaggtgtgagccaccgcgcccagccgaacatttccatacatctattttggtgcacagatgtgtggggttttgttgcagggtcataggatatgcattcatttacctttactagatactgtaaaatggttattcacagtgattgtacagcaaaaatttcccctccttacaatgtaaatgagaattccagagttctatatccttgctcagatctggtaatttctcctatttttgattagctctaatagtgagtgcatgaagttgtattaacttgctatactattgatccttaatgaagcatgcctcctggtattttgccatgtgtatccctacccacattgactctggtcttggccatgtgattagatttggccagtgggtgcttagcaagtatgatgcaagagaaggatttacaaccacttatgaacactgggaactcctaatctttgaatgctccttgttggaaatcagcttccacactgagaggagcccagtaatccacgtggagaggtctttgggggagaaccaaaacttctggtcatagtccaagctaagcttccagccaaccatgagcactacttgctagacacatgagtgaggtcattttggaaattccagctgtcttagcaatagtcaatgtcaccggaagcagaagaaccatggcccagtcaagtcacagagtcatgaataataaataattgttgttatattaatatgttaactttgggatgacttgctaccaagtaaaaataacttagacaaaaacatctaactggttttaatgtttatatatctggtgattttaaatgttgattatcttattgatatttggccatgttctagttactattgatgcataacaggccaccctggggcattaagcaacagtcagtttcttataccagttttgtggcccaagaaattagggctcagccatgagagtgtgtttctgctacccagcactgggggctgaaggctggaatcatctggagactccttactcactcgtatgtctggctcctgggctgggatcagtgcaagtctgggctcacctggcacttgattggagcacctacacttgggctggccatgtagtttggcctctcacagcatgaagacttgattctagtatggagcataccaacagggggcctcttgaaaacgagatggcgctccatggcctcttatgatctggcctcagaaatctcatatcatcatttcaccacactcgatgggtcaaaacagtcactgccacaatatattcaaggccacagaacctacttcctgatcagaagattgtgaacgaacaaactggggaccatacgtttaacctctcattttgcatcctctaaagtatggtgcttgttcaagtccttgggacagaaaaaatttgtttcacttaggctatttttttcttgttgctgtgtagctgttacatatatatgatatgtatgtgtttgtatatattctcttttccccattttgtgaattgttttatctcaatagtacatattaataaacaaaagttataattataatgtaattccatttgtattagtctttttcttttttttggagacagaatctcactctgttccccaggctggagtgcagtggtgccatcttggctcactgcaacctccgcttcctgtgctcaagtgattctcccacctcagcctcccaagtagctaggattataggcacccaccaccacacctggcaatgtattagtctttttatgtctggtttaagaacaattggtttaacccaaggtcaaaaaattattctcatatgtaatattatagaaactatatttctttacctttcacacttaagtctccattggaattgactttagtatatgcattaggaaaaagacaaatttttttccttatgtggttatctgattgatctagtctcatttgctaaaaaggaagaatctttttttctaatttgggtaactatgtatatctggatctgtttctagacactctattctattccattagtctatttttcctatctatctatcccaacaccagaatgtcttaatcactgtagctttgtagctttataatacattttgatatctggtagtacaaatcagcttgccactacacacacacacacatgcacacacacacacacaaaaccctactgagattttcactgggattacagaaaatttatacaaaaattggaaaaaatttacagattataaataatgagtctttcaatccatgaatatggtatatatcccatttatgtaatttctctcaattatgttttatggctttcagtgtagaagttttgcacatcttgattacatttatcctgaagtctgtaatgtttgtgttgctattgcaaatgatattctaaattctaacttttttataaatcttttttctattttttgctagtatataggaacataattatttcacttaatcagcaagcttgctaactataattatttttgacagcttttccaaagatatttttggatttcctacatagccacttacgtctgcaagtaatgaaagtttatttcttcttttctaatctatttagattcctgcttttaatcatttatacatatttcttgccttattgcactgacaagacataatgttaaatatcgcagtagcagccgataacttggtataattcctgatctcaagggaaaagcttttatcatctttcagtttcatacttgtgatttttttagtaatgattattaaaatagagaaaatttattttttttgcgatgtttcatttttaatgtataacagttttctgaaatattaccgttgttttcattgtataggtacatgtacatgtgcacacacagacacatgcatgtgtgtaaatactaatttttatttatttatttatttttattgatcattcttgggtgttcctcgcagagggggatttggcagggtcataggacaatagtggagggagggtcagcagataaacaagtgaacaaaggtctctggttttcctaggcagaggaccctgcggccttccgcagtgtttgtgtccctgggtacttaagattagggagtggtgatgactcttaatgagcatgctgccttcaagcatctgtttaacaaagcacatcttgcacagcccttaatccatttaaccctgagtggacacagcacatgtttcagagagcacagggttgggggtaaggtcacagatcaacaggatcccacggcagaagaatttttcttagtacagaacaaaatgaaaagtctcccatgtctactactttccacacagacatggcaaccatccgatttctcaatcttttccccacctttcccccctttccattccacaaaaccgccattgtcatcatggcccattctcaatgagctgttgggtacacctcccagacggggtggtggccgggcagaggggctcctcacttcccagtaggggcggccgggcagaggcgcccctcacctcccggacggggcggctggcctggcgggggctgacccccacctccctcccggacggggcggctggcctggcgggggctgacccctacctccctcccagacggggtggctgccgggcggagacgctcctcacttcccagacggggtggctgccggacggaggggctccttacttctcagagggggcggctgccgggcagagggtctcctcccttctcagacggggcggccgggcagagacgctcctcacctcccagacagggtcacagccgggcagaggcacccctcacatcccagacggggcggcagggcagaggcgctccccacatctcagacgatgggcggccgggcagagacgctcctcacttcctagatgggatggcggccgggaagagatgctcctcactttccagactgggcagccaggcagaggggctcctcacatcccagacgatgggtggccaggcagagacgctcctcacttcccagacagggtggcggcctggcagaggctgcaatctcggctctttgggaggccaaggcaggcagctgggaggtggttgtagcgagcccagatcacgccactgcactccagcctgggcaccattgagcactgagtgaacgagactcggtctgcaatcccggcacctcgggaggccgaggctggcggatcacttgcggttaggagctggagaccagcccggccaacacagccaaaccccgtctccaccaaaaaaatacgaaaaccagtcaggcgtggcggcgcacgcctgcaattttcgcaggcacttggcaggctgaggcaggagaatcaggcagggaggttgcagtgagcggagatggcagcagtacagtccagcttcggctcggcatcagagggagaccgtggaaagagagggagagggagactgtggggagagggagagggagacggagagggagagggagagggagacggagagggagagggagagggagagggagaatactaattcgaaaatttattttttaattgtacatttttatgggagcttcctgattgaggtatactccacccagtcttaaatctgagctccatagaaactgaggcaaagacagaatcatgactaattacatagccatcattgtttactagaaggaatcatacccaaatgaatgaaagctccatgagaaaaagaacttcacatggagtcttcaatgtcatgtaacaagtgcctagaatagggccaggcaaacagtaaacattcaattaacatttgctggctgggtgcggcggctcacacctgtaatcccagcactttgggaggccgaggagggtggatcacaaggtcaggagatcgagaccatcctggctaacatggtgaaaccccgtctctactaaagatacaaaaaaattagccgggcatggtggcaggcacctgtagtcccagctagttgggaggctgaggcaggaaaatggcgtgaacccagggggcaaagcttgcagtgagccaagattgcgccactgcactccagcctgggtgacacagcaagaatccatgtcaaaaacaaacaaacaaaaacatttgctgaatgaatatcgattatgtgggtcctaagaggactttgttttgcctaaagttctttgttagaagttctaatcaactaataatgacacccttgcagaaattttatttttaaatgaagacatgttttatatttggctgtttcttaaatgagcctccgtgaaagtcatgggcagtagagtaaattgtacttgtgggaaatgcaattgtacttgtacttaatgcaaggccaaagtgatgtagtttgggtttgcagcttattggttcagtacaggtttagtgccaactttccaataactttaaataataaatgctgctcagaatggaataatctattattctaaagcacagttccatttgcttaagaatatgtaaatatcgcaccttcttgtataacttctataaaaagattttgaagttttaattatttaaaggttatatacaaaaagctactttagagggaacttttttataacacggtgttcttttattttccaggaagagagaaaagccaaaaagtaattaaaataatgaaggtgaaagtgattattatctccatagtatctccaaaaacgaaatagaatgaaacacaacgaaaaacgaatttaaacaatacagaaaataattaaaaccttgctaaaattgtttaggttctctggcttccagtgaaaaatcagactaaaggatgaccaattaaatcagtgttttcactgtaggaaatgctaacgtctaaagaggcagaagaagaaaaaaatattttacaggtcagggataagtcatgaaaaggataatagggaaaaaggataaaatagtcaaaaacaggtaaggaagggattaaatgacagtaatactgctcttttagaaactctatttaattgactttgccaccatgaaagctttcatattctccaaatatcactagggagtcctcagaattatttatatatgacttaatgactcataatagaaaatatattcgatataacatgggactctgtgtaaactgggggctttttcagagtaacagcttgtcaataattcatcttgtccatggtcaaatctcgtcaaagttcacctcatggctatacattcgaagttcaaatctctcaccaaaatacaacataaatttcagagaaacagacctgctcttgtatatgtatatatacatatcaattaagtggtgcattttcttttttttttaataatgaacatcgtttattttcataaaggaaaaataccttttttttattattattatactttaagttttagggtacatgtgcacaatgtgcaggttagttacatatgtatacatgtgccatgctggtttgtaatagaagtaacagctgcaagaactatctgacaaggtattataaaactctaacctactgcatcaacacttagtatcataaagctattgtcctgccagtctctcagaggtaactatgaataaaatcaggttaagaattctaccatatcatcctcctattgatgatttgcataggaactatggcaagcagcttaggcactggaatatttcaaataaattaataatgctgaaataagtcaaacaccattttgcttactactgcagaaaatataatgctatgactgctgataatctctgaaagttattcattgtgtataactgaaactgtatatacattgaacagcaactgcctaattccccttccctgcagccctgggcagctaccattctactttctgtttctctgaatttgactatgttagatatcctatatgagtgaaattatgtaatatttgtcattatgctgctggctaatatcaattagcatcatatcctccaggttcatctatgttgtagcatgtgacaggattttcttgtttttttaaggctgaaaaatattccatggtatgcatttaccacattttcttcattcaaccattaatggacatttagtttatttgtatatcttagctactgtgaatagtgctacagtgaacatgaaatcctttctcaaaaaaagtaaaaatagaactaccatgtgcatttccactctgcaatctcactcagattacataacccaaaaaaattggaaacaagatcttaaaccacttttttttaacaaatggtgatttgagtcaagagagtagtaacttgagagatcacatagctaagaaatggtggagttagaaatcagatccagatgtgtctaactctagtatgtattcttaaacaaaacattaataattgtttcagaaataagtaatatatatctttttatcattttttaaaaaactgtgaatgcataatagcagattacctgatgaccatatgagcctgtcagaaaatgaatttgtagtgtctgttttagcataaggaataaaggaatataaatgtacagaaacacttatgtaaatcccattgtgctggcagaattggctaactggaagaaaatgctgaccacttactgcatatcattaaaaaaattaaattttaaatggtttcaagttcaaaatatgaagagtgataattaagaaagtaaggctgatgccatgtctcaagcctgtactcccaacactttgggaggccgaggtgggccgatcacttgagatcaggagttcaagactagcctggccaatatggtgaaacccccatctctactaaaaatacaaaaattagccgggcgcggtgttgggtgcctgtagtcccagctactcgggaggctgaggcaggagaattgaattgctggagcgcaagaggcggaggttgcagtgagccaagatcgcaccagtgcactccagcctgggcaacagagcaagactctgtctcaaaaataaataaataagaaagtgaaaaactaaagagttcaggggaacatcttaaaataatggaatggagcctactgaagcaggatgtgattacaaatgaatttgaattcatttatatgacaatatgaattgggtacttaccatgtatcagacactcttctaggtactagggttatggtatgaacaaagcagacaataatacctgtatgtggaatttatattttactggggaaaagacatgataaatacaataattaagaaaaataatatgaaatggtgattagtgctaaagagaacaaaaagaaaatgggacagagaatgctggagcaggactgatggattttcactgagatggacacgagaagcagtcctgcaatgggacgtttaaacagagatctgaacaaggcaagggagtgtaccatcgcggtaagtggcgaatgagctctcccaggagagaggcgcacatgaagtcctggaggtaacagtataagtaccaagctggagcaaagttagcaatggggaggggctagtatgcacagagctgctcctatattttaatggttgcagagctgccgagaagtccgtgtgcacatatttttcttaataattaataatcagtgttctgaggtctttgtaaaacacacaacttttagcagaatgactgcccagctgaaaagttgagcgttgactacagggatccactcagaggaggaggccaatcccagggcagttcacctcatacccgggcaggctggtctgtaaggtccctcagccctgctgttgactatgaacaactctggaaggtgagcattcgtaagaaatgagcaatgtcggccaggcgcggtggctcacgcctgtaatcccagcactttgggaggccaagacgggcggatcacgaggtcaggagatcgagaccatcctggctaacatggtgaaaccccgtctctactaaaaatacaaaaaaattagccaggcatggtgttgggcacctgtagtcccagctactcgggaggctgaggcaggagaatggcgtgaacccgggaggtggagcttgcagtgagccgagatggcgccactgcactccagcctgggcgacagagcgagactccatctcaaaaaaagaaaaaagaaatgagcaatgtcttctgcaagctatacgtccactctaccagagggtgcctcccctgggaaacagccttcccaggaagccctttatcccaaattcctttttgttcttggacaaagaagagaaggttcaagttcctacttcacacctctccctggcttcagataatggaccccagattgggaatgagattgagaaaaggggaacaagagaaaaaggaatccagaaccggccacttcacaagcagtaacaaccaaatttgaaaggactacagtgttgttgccagtactgccctccgtgggcctccattggcccttccactggtgggccccagggtacttggttcatactcaggctctgagtatgaatggaagggccaatctcttaagcctgacactcttcaaaccagagaaaggaaatcacctgcaccattctttgactggaaaataatcaaagttgaggtattttataaactttaagtttattcttaatattattacaaatactttaagtgtatcaatatatgttctatcaaaaccaatcaacctcattttaaaaagcacattttcttcacaaacatttctgtcatctttaaaaagtctcccttttgagacaggccttgctctgtcactcaggccacagtgcagtagcatgatcatggttcactgtaaccttgaactcctggcctcaagcaatcctctcacctcggcctcccaaagcactgggataataggcgtgagccactgcactcagccaaaatctctttttttttttttttttttgagacagtctcgctctgtcacccaggctggagtacactggcgtgatctctgctcacggcaagctccgcctcctgggttcatgccattctcctgcctcggcctcccgagtagctgggactacaggtgcctgccacctcacccaactaatttttttttttttgtatttttagtagagacggggtttcaccatgttagccaggatggtctcgatctcctgacctcgtgatccacccgcctcggcctcccaaagtgttgggattacaggcgtgagccaccgctcccagccaaaaaatctcttttaaatgtactcgtctgagcagctcatcttagccctctgagaaagccaatacactgttacagaaatcaaaactctctctcctttgttcatgacctaggacaccaagaatcaatcctgcttatacatacagtcgatcagttatagaactttgttttagcctatttccccctacacaccacacaggcttctgactcagttttgctctgtgtggaagaatttcaatccaaatctgttggggtatggtagcaaggccatgttttccaattctttggaagttggtggtaactaaaatggaaaagagattcttagcacaaggaaaattagagatttgattagctatatgaaatttagtcaatcaaatattccatggtatgcatttaccacattttcttcattcatccatcaatggacacttagtttatgtgtatatcttggctactgtgaataatgctacaatcaacatgaaaccctttcttaaaaaaattaaaaatagaacgaccatgggtaattctactctgcaatcacactcagattacataacccaagaaaactagaatcaagatcttacaccactttttttttaacaaatggtgatctcaagagaggaaaagttcagattcaaacgactcaaagaggtaaatttgtaggtaaaaaaaaactgagggcctcaatatgatagtttctcttccttgtgctggtaccgtgtacagcagtgtggcatgccatatgacaaaggtgactgaaaaacaaattccaatgctacagtgtccaggacctagctcattctttatagtctgtgatccacatcaccaccacaaagttcatccctgcactttgaaggtcccaacttatgtaaattccacacatcacaggacaataaaaacaagttattctaaatacttagaagggaggaaagaatacaaagtatgaaagaaaatatgttggccgggcgcggtggctcacgcccgtaatcgcagcactttgggaggctgaggcgggcagatcatgaggtcaggagatcgagactatcctgactaacatggtgaaactccttctctactaaaaatacaaaaaattagccaggcgtggtggcgggcacctgtagccccagctactcaggaggctgaggcaggagtatggcgtgaacccaggaggcagagcttgcagtgagcagagatcgcaccactgcactcgagcctgggcgacagagcgagactccgtctcaaaaaaaaaaaaaaagaaaatatgttatgcacatttctttccagttatagccagtgacagctcttctactggatcagctatcgattgccacaacaaagctgcataacaaacaaccactcaagctcagtgctctcttggcagccacagaggagctagagaggaagtggaaatatgcaagggccttgttgaggctctgtttttgtcatgtctgttagtatccctttaccaaagcaatgcacatgggcaaggccagtgtgagaatgggaaggcactgcaaagtcacgtgactgagggcaacaggcagaaaggaatgatcagatgcttaacgtgttactatatttcagttattgaatactcatttgattattgtttttagattcaatctcttaatgatgttttccaccttggcatctatcttcctgaatatactaatcactattatgtcagtctgcctctgttaacttcaatttctggatcaactctgcatctgtttctattatctgttttttcttggtcttataccttagaatgcctaatagttttctggttctttctttaatttaataactgatgttgtggatgaaaaaatatcaattcattagagagcattatcttcttttagaatgaatttttgaggcatctggcagggcagttatgttaagggaaatttccatcatcttaacacaatgaggcatggggctggtttgagattggatttcagtctttctaagtcctaatataattcttatttcccctgactcctatggtgttgtccttctggcagcacaactaaagttgagggtaattaccagtgaacttcagaatccaaaattccaatgttcaccttttcagcactcatgagacagctaatagttcagctgaaattttctgacttttttcacttggcatcattccctagaatgatgttccatagaaattgttgtgtacatcattgttcatttctttgtattactgagtagtattccatgttatgggtgcatcatagtttgtgtaaccattcacctattgaaggacattttgactgtttccaatatttggctatttcacataaagttactatgaatgcttgtgtacaatttttagtgtggacataagttgttatttctcttggatgaatacccaggaatgcaactgctgagttgtgtagtaagtgcatatttagttttatcagaaactgctgaatgattttccagagtggctgtgtcatttttaacttccaccagcaacatctgagtaatccagtttttctgcatcctcaccagtacctggtgtcatcaacattttttattttagtcatgctgataggtatatagtgacatctcattgtgattttacttttgtatttctctaatggctgttagataactttttgtgtgctattaatcatctatatatcttcatcagcgaaatatctgtgcatttcttttgcccatttcccaattggattctttatgttttactgcttattttgaggcttctttatatattctaaatactagtcttttgccagatacgtgagttgaaaatattatattactgtctgtagcttatcttttcattctctttacagggttttaatttgataatgatcaaggattttgactcctaggtaattcctcaagaagctacatatctaatagaacctaattctacatttgctaggggacacatgaaagagtgttccaagcagaaccgttcacagtacaaaaaccctagagataatatgtccactgacacaagtaaatgagtaagtgctaagatattcacagaaaggaatcgtataaaggaatcaaagggaataaccaaccatgtggttgaattttagaaataaactattatatttctaaatataatataatatatattatatttctaaatataatataatatatattatatttctaaatataatataatatatattatatttctaaatataatataatatatattatatttctaaatataatataatatatattatatttctaaatataatataatatatattatatttctaaatagtatatttagaaatatactattgagtggggaaagaagattgcttagtatatgttttctataaagttagaaataaaatatattggcaaaattatagaagcaacaaaaatacataaataaaaatgggttaattaacaaagtggtgggatgactgttacttttggtgggaagaagagaaggttttgaaatgtagggggactataaagctaaatgtaaattatggccaggttaaagcaatgagtagtagactcacaggtgcttcttaccttaacaagtaagcagtctgttgaaaaaaacaaaaaaattaagtaaaccagcacactaaattcagtgtgttgtgaacatgagtcacattcaaaaatttttaaggggaagaaatagcaaatacatgatttcagttttatgtggcattagtttattatgagatggatgaatggatggatggatggatggatggatggacggaggacaaaatggaaagattttagtgtatcagttactatttattgcctacctgacattcaaagctgcttctttctttctgacatgatattgattttttttttaggtatccaccctcctttatttaactcatgcttgcttcacagattctaaaaggcaggtttggattccttttatgtgttcataagggccccactccctttgcagctaattgatgtagacaagcaattaagtggttcttgctaaacagatttgaatgttactctactaagaatcttctgaaaatgtatcttcattctttttttttttttttttttttttttttttgagacagagtcttgctctatcgcccaggctggagtgcagtggcacaatctccactcactgcaagctccgcctcccgggttcacaccattctcctgcctcagcctcccaagtagctgggactacaggtgactgccaccacacccggctaatttttttgtgtgtgtttttagtagagatggggtttaccatgttagccaggatggtcttgatctcctgacctcatgatccgcctgccttggcctcccaaagtgctgggattacagacgtgagccactgtacctggcccccagtatcttcattcttaagaaggtacattattttattttttgcctatcaatgcttcctagcctggaggatatgaaaatatatctaaatcaactgcaaggaccatgccacctttagagagtgatctagaagatcaagcccacacattgagtttggcagagaagaaagagggccttagccttactgaactgctggacttaaaaaaccttggacctaacctgcctttgcacttattttgacatttactttcctattaatccagttgattttttttaacttacaatgtagatatatagatgatacataaatcactttaaatgacaggttagaaaacatttacttcaagtagccatattatatggtgaatactgtcaaaagattcaaaatcattatgtgatgggcctggccaagacaatggtatgcatcagggatctggaagaaccagcacattcaaattgggcaggctgagaccagcttacaaaggtctgggtaggatgcagggaattcccaagtgatatggttcggctgtgtcctcacccaaatcttatcttgcattgtagctctcataatccctgtgtgtcatgggagggacccagtgggaggtatctgaatcatgggggcaggtttttcccatgtcgttctcatgatagtgaatgtctcactagattggatggttttataaagggcagttcccctacacatggtctcttgcctgccgccgtgtaagacatacctttgttcctccttcaccttcctccatgattatgaggcttcccccgccatgtggaactgtgattccattaaacctctttttctttataaattacccagtctcgaggtatgtcttaatgcagtgtgagaatgaactaatatagtaaactggtaccagtagagtgtggtgccgctgtaaagatacccaaaatgtggaagtgaatttggaactaggtaacaggcagagggtggaatagtttggagggctcagaagaagaaaggaaaatgtgggaaagtttggaacttcctagagactgttgaatggctttgaccaaaatgttgatagtgatatgcacaataaagtccaggctgaggtggtctcagatggagatgaggaacttgttgggaactggagtaaaggtcactcttgctatgcaaagagactggtgacattttgcccctgccctagagatctgtggaactttgaacttgagagagatgatttaaagtatctggtagaagaaatttcaaagtggcaaagtgttcaagatgaagcagagcttaaaagtttgaaaaatttgcagcctgacaatgcagcacaaaagcaaaacccattttctgaggataaattcaagccagctgcagaaatttgcataagtaacaaggagccaaatgctaatcaccaagacaatggggaaaatatttccagggcaagtcagagacctttgcaacagcccctaccatcacaggcccagaggcctgggagggaaaatggtttcctgggctgggtccagggcccgcctgctgtgtgcagcctttagacttggtgccctgcatcccagctgctccagccatggctaaaagggccaaggtacagcccaggccgtggattcagagggtgcaagccctaagctttggcagcttccacatggtgtgttgagcctgtaggtgcatagcagtcaagaattgaagtttggaaacctctgcctagatttcagaggatgtatggaaatgcctggatgtccagacagaggtgtgctgcaggggcagagccttcatggagaacctctgctagggcagtgtggaagggaaatgtggggtggaagcccctatacagagtctccattgggcactgcctagtggagctgtgagaagagggccactgtcctccagaccccagaatggtcgatccactgacagtttgcaccatgaacctggaaaagccacagccactcaatgccagcccgcgaaagcagctgggaggggagctgtgccctgcaaagtcacaaggatggagctacccaagaccatgggaacccacctcttgcatcaatgtgacctggatgtgagacatggagtcaaaagagatcattttggagctttaagatttgactgccctgctggattttagacttgcatggggcctggagcccctttgttttggccaatttctcttatttggaatgggaatatttattcaatgcctgtacccccattgtatatagaaaataactaacttgcttttgattttacagactcataggcgaaagggacttgccttgtctcagatgagactttggacttggacttttgggttaatgttgaaatgagttaagacattggaggactgttgggaaggcatgattgtattttgaaatgtgaggacatgacatttgggaggggcccagggaagaatgatatggtttggctatgcccttcccccaaaatctcatcttgaattgcagctcccataatccccatgtgtcatgggagggattcagtgggaagtaattgaatcatgcgggcgggtttttcccatgctgttctcatgatagtgaataagtctcatgagatctgatggttttataaagggcaattcccctgcacatgctctctgtcttgccaccatgtaagatgtgcctttgatcctccttcaccttcctccatgattgtgaggtctccccagccatatgtaacagtgagtccattaaacctctttttctttatacattacccagtctcagatatatctttattagcagcctaagaatggactaatacaccaagagagagtataatgccccagggccagggccactgtgacctgtggtaacaatggatgggcacagttactgggacctggagcacagaacatgtgtcaagatgccagttgtcaggagctgtgtggcagttatctattccacaataaaactggggatatcaatatccacaagatatcaataaaattgattatctcacagtttctgtggttcaggaatctgagaagggcttacctggaggcctctggctcagtctctcaaaagctgccatcaagtcacaggccagggtcatctcaaggctcacctggggaaggatcctcttctaagctcacacatgtggttgctggtatttggaaatggagtccttggaggttataggtttaggcgaggtcatgagggtgggaccctcatgaatggggttagtgtccttataaaaaggaataccagcaaattctctctctttttcccatgtgaggacacagcaagaaagcagacatctgcaaatcagggagacagccctcagcagacacaagacctgttgacgccttaatcttggacttcccagccttcagaactgtggaaaataaatgtttgtggtttaagccacccagtctatgatgttttgttatagcagcctgaattgactaagacagataccttgaaaaccaccatcccctgctgagcaatattgttctgctccttaggctgatttcagttttctttcacttagcatttcataactttaatttgcttgttaaaaaatttatctggatcttttattccctttatcctaaacttcaaaccacccactttcttttgcaagttttctgtttgacaccattcacttccttttctttctccttcattcatttctccctttctccctctttccctccctccctccattccttttgtcctttcttccttcctttcttctttcttcctttatttttttcatctgactctttccctggcaattgtccttggctccttcgtttacagtagtcactcttgatggtgagcattttgaatctccaaatgactatgaaatctttttatttctcattagcgcatgcaggtagtacatgtgtttcagtaaaattgaggaagcctggcagacactctgtggtctctgctgcattttctctggaatagctacagctctgtgtagcaatatggttaaggcaccatattgtgtgaaggcccacctagcctgggcatcactgtatctctgtcttcctaacaaaatgaagtggaaatttcaaaaaaatcaggagatggaacaaaagttttctcatgttttttactgcttattaaatgaacaacgaacaataatccaatgttaaatgtaaagttttcagccctctgcctgaataggctcacctagttatttgaacatgcctcactccaaatcttgtcctcagcaactgtggataaatcatgacagagaagttcccctaacctacagcagaggctcctcaagctatgccaccctactgatatagaagtggagaaagagtgctgggcgtggtggctcacgcctgtaatcccaacactttgggagtctgaggcagcggctcacgaggtcaggaaatcgagaccatcctggctaacactgtgaaacccggtctctaataaaaatacaaaaaattagccgggcgtggtggtgggcgcttgtagtcccagctacttgggaggctgaggcaggagaatggagcgaacccgggaggcggagcttgcagtgagccgagattgtgccgctgcactccagcctgggcgacagagcgagagtccgtctcaaaaaaaaaaaaaaaaaaaaaaaaagaaagagaaaaagaaaaaaaaataatggagaaagaggtgttctggcccatttagttacattttccagggcaaaaatcacggatacatggtgaaattcaactatattctctgcccaagataaaatccaattacagcctctgctcaatgaggaaatcccatcacaggttccttttgcttcactaggagacaaagagacaagtttgtttataatctatttatagaggcatacacaccttaaaaaaaagtggtcctcaagtaggagatttgcatttgttggtcattttatttctgggcagatgttcagtctttctaacttgaaaagtgtctagcaactttggctgaccttattaagattaatggtcataatgtatttaaatcccctgttgttctaagaaggattaaacaaaagttatgggaggcccttgttttagactgagctattacaaattgggccacaagagaccagactaaaccaaaatggagtcactcatgctaaataccatataattaaactggaactctaaggaaacaggtagatcccacatcagacttgtttttcctgaaatcaggggatacaagtctgagtcagtatactaaaaaagtcccctctgctttaacgcttatgaacaaagtaacctgcaggaacctgaagttaaccagtcagcttttgttctattgttctacttccttgttctcagtatgacctctcattctattttgtagtatggaggcatctctgattaacaaatcatgagaagaaagccaattagataaccaaataattattatctcttactgaaataactcccaaggacctttggcaagatctagcactaaccaaattttcccagaaaaaaattttgggaaaggactatttgtggattgtaaaccactactagggcagatcccaactgattagagatggattttgaggatgcactcaagaaaaagaagcacaagttaaagtagtacctgtcacctgtgctttttccaaagaaggttttgtgaacttcaatatttaaacaggaaagagtaagaaggagtggaagaaacaaaaggagggagggtaggcattgatgcaagtggtgaggcattgattagcactcagtgaatctatattttacacatgcaaagaagggcgtagaggaaaaagtcaattatgcattcatttcatgctcagtaaatctatattttccgtaagataaagcaagcatgtgaaatcatggttctttctgtttgggaacaaaaagaaggcagttttatgcgtgactcagttcccactcttaacttttcgctttggcatagtgagacgggagtcctaagacgttatttatttatttatttatttatttatttattgacggagtttcactctgtcgcccaggatggagtgcagtggtgccatccctgctcactgcaacctctgcctcccaggttcaagcgattctgttgcctcagcctcctaagtagctgggactacaggcacctgccaccacacaggctaatttttgttttttcagtagagacaaggttttaccatgttggccaggctggtcttgaactcctgacctcaagtgatctgcccacctcggcctcccaaagtgctgggattacaggcttgagccaccgcccctggcccagccaaggatttatttgtgcctgcagatagctgtatgaacagacacctgtaagaattgggggaattcctctcttctcaatgttccaaagtaacttgaggttccgggccattcaaaggtgaaattttttactcaccacaggtcaggagctttgtaaaggaattgcatgcagagggtaccatgccagtttttccaaggggtttttctcagcccttaaagtcaattttaattcctcaaagcagtctggttatttctgaaaaaatgtcattccagtcaaagacttgataaaatatccaacgtctccaattgggttctgttacaagagaaaacagattcttattgaacttatgcaaataattatattgccataaattaaggattgtcaaaaatagtttccaaattcggctgggcgcagtggctcatgcctgtaatcccagcactttggggaggccgaggagggcggatcatgaggtcaggagatcgagaccatcctggctaacacagagaaaccccgtctctactaaaaatacaaaaaaattagccgggcgtggtggcgggggcctgtagtcccagctacttgggaggctgaggcaggaaaatggcgtaaacccgggaggcagagcttgcagtgagcggagatcgtgccactgcacttcagcctgggtgacagagtcagagtccatctcaaaaaaaaaaaaaaaaaaaaaaagtttccaaattctggagaaatcaggtaaaagaaaaagaaacgtggctgggcgctgtggctcacacctgtaatcccagcactttgggaggttgaggcaggtggatcacaaggtcaggagatcgagaccatcctggctaacatggtgaaaccctgtttctactaaaaatacaaaaaaattagctgggtgtggtggcgggtgcttgtagtcccagctactcagcaggctgaggcaggaaaatggtgaacccgggaggtggagcttgcagtgagctgagatcgcaccactgcactccagcctgggtaacagagcaagactccgtctcaaaaaagaaaataaaagaagaaaaagaaaaagaaacgtgtttcagattctggtcataagagtatactttactcaattgttaaaaattataaatagatcaaaagaaaaaagctatctttttaaagtaatttctatttttattttagattcagggggtatatgcacaggtttgctacctgggtatattgcatggtgctgaggttttgggtacaaatgttcccatcacccaggtagtgaatataatactcagtagttttcaacctatgcgtcctccttccctcctacctctagtagtccccagtgcatatcattgccatctttatgtccatgagctcccaaatgtttagctcccacttgtaaatgagaacatgtggtattcagtttcctattcctgcattaattcacttaggatagtggctgcatccatgttgccgcaaagaacatgatttcattttttatggctgcatagtactccatggtgtatatgtaccacgttttctttatccaatccactattgatggacgcctaggttgatttcatgtctaaaagttttcttgactgaaaaaaaaaatcaacaatgcttcaaacaaaaagggttataaaatatatttcagtcctctgttagttcagttctatgaaattaattcatttcatttgatattgggattagtaatcctcatgaacacagtagctctacaatgagagttctggaagtttgtttctctactctactgatgaaatctccaaggttgtcagaaacttacatttgaagcacccatcagaatcctttctgtgaactaccctaaagaagcaagttttggactatagctgattattaactgctttttgagaagaatcaaataaaataataattgtctgtggatgacaaaagttttaggacagccatggttaaagataaggaaatttggttatttctgtgtcatactaaaatttaacttaataatacttattttgattattatgattatcagacaaatcagaactataggatctcattgtgccacggcattccgcctgggtgacagaatgagactctttctcaaaaaaaaaaaaattataagatctcatacaattttggaacacatgttaataacacacttatgtaagtagaacccaaagaaacttaaaaaccatttcatatttgaatgtttcctatatgattttaacatatcgaataagccaaatgtgtttcttttagacttcaggggacctattatctaaaaaagctaatgaagtaaaaaaaatactgaattacaattgaaattttaatgtttgaaagtttctcaaatgtcaaatgtttaaaacactctacaccgcaagatagaattacaggtcactataaaataaattattcacttagccacaatcataattcaaagactttaaaaatcattcactttttgatagagcagagactcagtttcccaaacaatatgacctaataaagatcgaatgaggcgaactgaatatctccctctctccctctttattttatagtttactcaagaggtaaacaaaaatctttctttatcaaaatagaaaaccagccgggcgcgatggctcacgcctataatcccagcactttgggaggctgaagcaggtggatcacttgagttcgggagttcgagaccagcctggccaacatggcaaaatcctgtctctactaaaaatataaaaattaggcagacatggtggcaggcgcctgtaatcccagctactctggaggctgaggcaggagaatcgcttgaacctggcggaggtttcagtgagcccagatcaggccactgcactccagcctgggtgacaagagcgaaactctgtgtcaaaaaaaaaaagagagagagaaaaccaaattttacttttacattagtgtagcattaacactaaagataatttttttttttaaatttagagacagggtctcgctatgttgcctaggctggagggcagtggctattcacaggcccatcccattactgatcagcacgaattttgccctgccccatttccgacctaggccagttcacccctctgttggcaacctggtagtcccctgctcccaggaggtcaccatgctaaaactaatttttaatgaaaccttataaacaaattcatccaatcttaataagtttgatcataaggtaagatttccataaacctctcatagcctgttatagttttctattaaagaacagattaatgctccaaggaaaccattgttgtcacacaggagcccagactgtggcatcagtgtgcttttgatattaatcctgaatttatagaaaaactaaataatatcttttaaattttagccaacttgatcacacacagaattccttttacaagatctgtcttccacaaaccttcttcaatttcctaacacctttagccttatcctatcattctgccttagcacaaaaatttactttcttttcaactttctatatccgtttagtttttagttttattcatcttttttcctcttttaatttaagaaaacctctagactaggcaaaattacttcccctttaagagaaaacatatttccatgccttctcataagctttttaccaaaacgtatctacttttctaagtttgcatattaaattgtttcttttatatctagtagttttcactacatacattgattatgttaactgttagtaactcttatttttagtgaaaaacttaggaagtaatttttactgtgtactagatgcagagtccagaacaaaggacaatgcctggaaatagggcttgttatattttagaggctcaaatctaaaaccataagtttatttaagagttatgtatcaaaaattacataaaagcaagttttgaccttaaaacatctagcagatatagtatcaaaccagtagaccaatagtctcagacaaaatgtctaaattctgaagatgtttccattttattttaccaataattttaaaactgtctttatttactaaagattattaaagtcacatgaactaaaaggcatttaagtttctatttttatgataaaatatttgatttaacacattttcattaagccaattagagtgctttcatattgaaggaagaccctctcatattattttatattgttttatactcagtacctgttttaagaaaaaacaacaaggaagtaaaaccaaagacaggcagcccagcgccaggcccgaaaccaggcctgggcctgactggcctaaacccagtagttaaaaatcaactcataacttagaaaccgatgttattcatagattccagacattgtatagaagaacactgtgcaactccctgccctgttctgtttctttctgaccaccggtgcatgcagcccctgtcatgtaccccctgcttgctcaaatcaatcacgaccctttcatgtgaaatctttagtgttttgagcccttaaaagggatagaaattgtgcactcggggagctcggattttaaggcagtagcttgccgatgctcccagctgaataaagcccttccttctacaactcggtgtctgagagggtttgtctgtggctcgtcctgctacaatatattttggtagtgaaacatcacatacacatacaacatataaataaatagataaacagaaacatagaagcagttcttacagatgtataagatttttcatccatcagttttaaatagttcggtttttttaattcatcctacaatgacctgttttactgccctaggcaattgttagctaggcaaccctaaatttgcatttctaaaggagaaaatttgcatctcaaagtatagaaagagactgggaatttaagctttttttaaaaaaaagaaatttggctgtgctagaggacaatttgaaaattaatgccagggtaatacaaaattatataaatgtattaaaagattttataaggagatcaatttcctttacataggtctctaccttttaactggaccgctgaacttaggacagagcccacactgaattttaggtctgcaaaaagagacatgccatggggacgggaccatacaatgttttcacagtgcatttcatcacaaagacattccccttgggcaacccaacaccaatcagcccattctgtgatctgcccattccctagccattatacacaccagagtcaagtttttcaaaatacaaaataatttctgttaccaccccgcccctcaaccaaaaagatcaggtaatgcaatacaaaagagagtagagttttagatacgagaatactctgttgcagaaggtagtcaggcagacatgagcagggcaggagaagggccccccaccaggattgtcaggcaaccatcaagtgatggtcaggcagttgttaaacagtcgctctaaaataataattggttgcagctggcgccagggaacgacaatctcccaataaatagaaacacctgtaactagtgatcagcagcttccaaataagatctcagaagttaggtgtgtgaaggaaaaatatcttgggtcccttcaagatgtgaaccgctcagggaaatctgcctcctattctgttcaagtcatccatttgctcacagagacagatgcatattctgattgcctcctttggaaagacttatcagaaactcaaaagaatgcaaccatctgtctctcacctacctgtgacctggaagcccccagtaggggggccttgctttgagctgtcaccgcctttctggacggaactaatgtacttcttatatattgattgatgtctcatgtctccctaaaatgtataaaaccaagctgtggccggaccaccttgggcacatgtcatcaggacttcctgaggctgtgtggtgggcgcggcctcaactgtggcaaacaagctttccaagttaaccgagaccactctcctaaggccttgctttttttttgagcaaaagtttgcttttgtattcttctcagttgactgaattctgttttcacctgatgttttgactaaaatagtattgcaacagaagctactcttggatttttaaagaagaatgtagtttagacactcaaaaatgtctttaaaaaaaaaagtacactgtaaaagcatctccctctagcactaccagacgtttttttctgtaccttatgatgtaaattttgctatttgattttcacctgagttgtttcctttaatgtgcaaatttaaggctatttagctgacaactgcctagggctgtgaaaccagttatctggaatctgaaagtctaagacagaaaaaatgcaaaatgcaggggtcttttgtcgtttttttgtttttggttttttttttttgagacaaagtttcactcttgttacccaggctaaaatgcaatagcaccatctcggctcaccacaacctcctgggttcaagtgattctcctgcctcagcctcctgagtagctgggattaccagcatgtgccaccatgcccagcttttttttttttttttttttgtatttttagtagagacagggtttctccatgctggtcaggcttgtctccaactcctacctcaggtgatccacctgcctcggcctcccagagtgctgggattacagtcatgagccaccacacccgactgggtctttataaatctataaaatgtacttccatctgtatgcctaatacgtctttttgtgtatttatgtgttgtatacaaaatgtttcactactaaaaagagctctagttaattgacataaaaataaaagtgcttaaatcaaatactaaaaaatgactagtcaaatgctttttcaagtttatgtaacaaataaaatctttaataaataagctagctttaaaattattggcaaagtaatattagaaatgtgttaagaattgccagcagacatttttgtttgtatttgttaatcaagcaatttcatacttacccccaccaaatactataaggtgtcaaaatttggcataagggttataaaacccaacccaaatcagaatgatctttgcttgtgtaatttttaataaataggacattgacatgggtataatgaaaatagctgcatcttgaatttagcaagattactataacttctaatcctgcggctgtaggcagtctaattcacagacaatgggaaggtttgttgggaaagggctgttatcatctttgtttcatagctaaattgtaaactaagttcctcccaaagttagttcggtctatgcccaggaatgaacaaggacagcttggaggttaagagcaagatggagtcaattaggtcaaatcttttttttttttttgagatggagttttgctcttgttgcccaggcaggagggcaatggcaccatctcggctcaccgcaacctccacctccaggttcaagcaattctcctgcctcagcctgcctgagggaagaaagagaccctctcatattgctttatactcagtagctatttaaataaaaaaataaggaagtgaaatcaaagacaggcagcccagccccaggtctgaaaccaggcctgggcctgcctggcctaaacccattagttaaaaatcaactcataacttagaaaccgatgttattcatagattcccgacattgtataaaagaacattgtgaaacgccctaccctgttctgtttctttctgaccaccggtgcatgcagcccctgtcatgtaccccctgcttgctcaaatcaatcacgaccctttcatgtgaaatcttcagtgttgtgagcccttaaaagggacagaaattgtgcactcagggagctcagattttgaggcagtagcttgctgatgctcccagctgaataaagcccttccttctacgactcgttgtctgagaggttttgtctgtggctcgtcctgctacatttcttggttccctgacagggaaacgaggtgactgatggatggccgaggcagccccttaggcagcttaggcctgccccgcggagcatccctgcaggggactccggccagcctgagtgacgcgatccaaagagcgctcccggttaggaaattgcccccattggaacgccttgccagagcagcacgtagcaggcccccgtggaggatccacacagtggctgaacactgggaaggaactggcgcttggagtctggacatctaaaagttggtaagactagtctttggaacttgccccactccatctgagtggaagcgtggcttgatcacccacggtgtgcctgcattggcacttttgttctggatttgacttgatttgaattgctggatactttggtttggttttggttttgacttggcttgaattttttggtactcggattttgaatttcgtgattttggtttggcttaaacggtaaaagtgtgtgtttgccctctttgcccgttctttgtcttgtggtgagtgtgtgtggtgtgagcgtggtattctgtcttggagaaaaaaaaaattttttcaagaaagaacttaagggagattacagtgctactgtgacaccaggaaaacttagaactttgcgtgaaacagactggccagcattaaaggtgggttggccatctgaaggaagcctggacaggtcccttgtttcaaaggtatggcacaaggtaacctgtaagccaaggcacccagaccagtttccatacatagacagttacagctggttttagacccccttcccccctacagaagttaagagaacagcagcatgagcagctggcagaggcaaggaaagaccagcagagagaaaaaaaagaccatctataccaattctaggttaatttagactaaacaaggtcttattaatagcaaaggataattgaaatcccaaacttacaaggttttcaacaaaagtgaagtttgctaaaagttaaaagtgtagcatgtattatggtaacttctaatcttgtggccttagacagtctagtccaaagacataaagaaaattcgctttaaaaaaggggaaaaaaggggggaggcagaatttatataaaaagaatgttatatggtaaattcttgtcctgaaataaattaactgattgtttaaagaaaaaaagtttgtaataagtcagaaagttaagacatgttaaaaaattgtctgtgaaagttgtgaaagaaaaaatgttatcaaaaattttatgcaaaaaatgttgtataacttaaaagtaataaggcctcctgagtactactgaagaaacagtttatgtgcaaggtgtataaaaaaatatacctttgataaaaagattataaggaggcataagaatgtgaatttttacctacattaaaaggttaaaaaaatattgttttaaaagtttaagcaagttttaaaacgttaattgtaaagaaaattctgtgtgtaaacatattaactaaagttaaaaaggtatcatccagtttttctgtagactagacattaaagtaaaaatgcaacagatttttcttaaagcatcaacctgctctttaacaaaaattataaaaggttaaagagtctataaaatcttaccttatagtcaaacatgaaaaattggataaatatgtctacaaggttttattaaaattaagtttaacattaataacacactaatataaagataaaatttagcttctctggtataaaaatcatacaagaagcattattaaatataaaatggtgtttagctttctttggtctaaaaactaacaaaaataggtgctaaaggaagcattcattttactaaaggatcatagaagttaaagacttaaaacaaactttggcaattaagacaggataccaagatgcaaatgcctggatgaaatggatcaaatattccatctgcacgttaaacaaaagcaattgttatgcttgtgcacatggcagggcagaggctcagaatgtcccctttccactaggtggtcctccagtcgaccaggtgtgggctgcatggtagctcttttccaggattctacagcctggaataataagtcatgccaagctctctctgctatattccgaagtccctgggggcagccaccgagggccatccagcttccatctcccaacactaacttcacttcgtgtctctcacggcagggaggagacttagcattccttggagacctgaagggatgcagtgagcttaagaattttcaagagtttatcaatcagtcagcccttgctcatccccgagcggatgtgtggtggtattgcggtggacctttactggacttactggacactctgccgaataaccagaagtggcacttgtgctttagtccatttggctatccctttcaccctggcatttcatcaaccagaggaaaaaaaaaataagacatcataaagtgagagaagccccttatgggtctttcaactctcgtatatatttagatgcaattggagccccgcaaggaataccagatcaatttaaagcttgaaatcaaatagttacaggactgaagtcaatattttggtagatgacagtcaataaaaatgtaaattagatacactacatctattacaaccaacagcaacgagcttttcatgagttaaaaagaaaaactcatgtcggccccagccctggggctacctgacctgacaaaactctttacactccatgtgtcaaaaagaaaaaaaatggcagttggagttttaacccagactgtagggccctggccaaggccagtggcctatctctcaaaacaactagatggggtttccaaaggctggcccccatgtctaagggccctggcagcaatggccctgttagcataagaagcagataagctaactcttgggcaaaacctaaagtccccccatgctgtgatgattttaataaataccaaaggataccattagctaacgaatgctagactaactagataccaaagcttgctctgtgaaaattcccgcataaccactgaagtttgcgacaccctaaccctgcacaccttactcctggtatcagagagcccagttgaacataaactgtgtagaggtgttagactcagtctaccctagtaggcccaacctccgagaccaaccttaaacatcagtagactgcgagctgtatgtggataggagcagtttcgccaacccctgcaaagtgactctgaaaaagacgacaagccctgctccagtcgcacccggaagctgactggtccacgcacggccaaaacatgaggaaactcatcgcgggactcattttccttaaaatttggacttgtatagtaaggacttcaactgaccttcctcagactgaaggctgtttccagtatatacatcaagtcactgaagtaggacaaaagattgctacagtcctattattttatagttattatgaatgcctaggaactccaaaaggaacctgtttgtataataacacccaatacaaagtatgtaatccaggaagtgaccagcccgatgtgtgctatgacccctttgaacctcctatgatcacagtctttgaagtaggactgagaactggtcattctctaagtgacacaagtaaagtaatagctagaacagaagaaaaaggggtcccaaaaatgtaaccttaaaatttgacgcttgtgccactattgatagtaagcagcatggaataggatgcggttctctaaattggaaaaaaaagttacacggtaaaaaaaaaaataggtatatctgtccagaatcatatgtgagatgtgtcaatactggtcttgtgtcatctgggctacttgaacagaagataaaaaagatcctgtttggctccaaaaaggaaaagtcagcccctcctgcacaagtgggagctgcaaccttttagaaatgataatcacaaacccctcagaaccagaatgtaataaaggaaaatatgtatctttaggcattgatggaaagggactagatcctagcgtgaacatcctaataaaaggagaggttcaaagacactctccagaaccagtatttcagactttctatgatgaactaaatgtgccagtaccagagactccaggaaaaatcaaaaatttgtttttgcaattagccgagcacgtagcccagtctctaaatgtcacttcatattatgtttgtaaaacaactgtaataagagatcaatggccataagaagcctgagaattagtgcctacagacccagttcctgatgaattctcagcccaaaagaatcaccctgatcatttctaggttctaaaagtttcaattattggacaatattgcatagctagaaaaaaaaaaagaattcactcattctgtaggatgacttagttgcctaggacaaaaactataatagtaccacacacacacaaaacagttacatggtggagctccaattacacagaaagagatccattcagtaaatttccaaggttgcagactgtctgggctcacccagaatttcaccgggactgggctgcccccaccgggttatactggatatgtggacacagagcttatgctaagctgcctgatcggtggacaggtagctgtgtaattggcaccattaaaccatctttctttttactgcccataaaaacaggtgaactcctgggcttccctatctatgcttctcatgaaaaatgaagcatagccataggtaattaaaaagatgatgaatgacctcctaaaaaattatataatactacggaccccccacttgggcacaagatggctcgtggggatatcggacccccatctacatgctcaaccaaatcatatggttacaagctgtttcagaaatcatcactaataaaactggtcaagccttgactattctggcccggcaagaaactcagataaaaaatgctatctatcaaaatagattggctctcagctacttgctagcagctgaaagagaggtctataagacatttaaccttactaattactgtctatacatagataatcaaaggcaagtagttaaagacatagttaaaaatatgacaaaactgacacatgtgcctgtacaagtgtggcacgaatttggccctgaagccatgtttaaaaattagttcccagcactaggagaatttaaaactcttataataaaagttataatagtaataagaacctgcttactgctcccttgtttactacctgtacttcttcaaatgataaaaagcttcatcactaccttagttcaccaaaatgcttcagcacaagtgtactatatgaataactatcaatttattgcacaaaaagacataagtagcaaaaataagagtgagaactcccactaataaaaagtgagagtctcaaagggggaaatgagggaagagagagaccctctcatattgttttatactcagtacctgtttaaagaaaaaaaacaaggacatgaaatcaaagacaggcagcctgatgccaggcccaaaaccaggcctgggcctgcctggcctaaacccagtagttaaaaatcaactcataacttagaaaccgatgttactcatagattcccaacattgtataaaagaacattgtgcaactccctgccctgttctgtttctctgaccaccagtacatggagcccctgtcacgtaccccctgcttgctcaaatcaatcacgaccctttcatgtgaaatctttagcgttgtgagcccttaaaagggacagaaattgtgtactcggggagctcagattttgaggcagtagcttgatgatgctcccagctgaataaagcccttccttctacaactcggtgtctgagaggttttgcctgcagcttgtcctgctacatcccaagtaactgggattacagcatgcaccaccatgccaggctaattttgcattttttttctttttttttttaaatagagacggggtttctccatgttggtcaggctggtctcaaactcccaacctcaggtgatccacccacctcagcctcccaaagtgctgggattacaggcatgagccaccgtgcccggcctagatcaaatcttttttcactgtctcagttataatttttctttcttttttttttttttttttttttttttttttttgagacagagtctcgctcagtcgcccaggctgcaatgcagtggtgcgatcttggctcactgcaagctctgcctcccgggttcatgccattctcctgcctcagcctcccaagtagctgggactacagacaccccgccaccacgcctggctaattttttgtatttttagtagaaacagggtttgaccatgttagccaggatggtctcgatctcctgatctcgtgatccacctgcctcagcctcccaaagtgctgggattacaggcgtgagccactatgcctggctggttataatttttcaatagcagtttcataactttaaattcatgactattacagtattcataaataatctaggtaaataattaaaatagataattaggcaaatgtaatgggaaaaatacttgtagacaaactggtcataatttagaatataaagttatattaaattaaataatagatgtttcattacttgggtattttccaataaatatatattgcaggaaaacattcttgctaaaaaaaaaaaacaaaaacagagaagtgtgtccttttaaaaagaaaagtgaaaaatttatgtctaattcaaagcttatttaaacattatgtataaaacaaggtaaatggaaccaggaaataaaaaatatgtaaagaaagttgtaaaaataaagaggtatttttctgaggtaaaaaaagcttgaagaaaaataattttatataagaaaaaaagtcttgtgccaggcaccaaatacccggcatcataattgttatgttaaaattattgtgtgccacagaggcaacaaatttccttgtcaattgtgcctttcgactatggctgccttaaaactttttttttcagccgggctggtggcttacgcctgtaatccctgtactttgggaggctgagacaggcgatcacgaggtcaggagatcaagaccatcctgactaacacggtgaaaacctcatctctactaaaaatagaaaaaaattagcttggcatggtggcgggtgcctgtagtcccagctactcaggaggctgaggcaggagaatggggtgaacctgggaggcagagcttgcagtgagcagagatcacaccactgcactccagcctgggcgactcagggagcctccgtctcaaaaacaactttttttcatccatggacaattgttgtcttgttttggtcctctttaggaggtggttttataatcagctataaaactccaataggtgctcttgaatgcaggtttctgataactttggagattgtgacaacagaatagaggaagaaccttcaggactcatggagagctaaatgttcatgagtatcaagcaggaattaacaggaattaactgcatggactgaaccaatcttttttactttttgctcaaaatatttgctggtcctttgttttgcgtttccgagtcttatgacttttcttttgagctactgacagattttaacaatttagtatactcctatgaacaaaatttgtggcatagttgtttctatctgatttatccagaatttggaaactatttgtgagtattcttaacttatggcaatacagttatttgcataagtgcagtaagaatctgttttcatttgtaacaggacacatttggagaatttggttattttaccaaggctttgactggaatcatgtgctttccttataaggaatcaaacttgacttacggagccaataaagcccttggaaaaactggcctcatattctgtatacacagtccctgaacagggtttctgactgtgtaagtaaagaatatcactttttgacaagtgcagacgccccaggtttatcttgggccctcaaaaggagaggaaatttcacccaactcatgggtatttaatggcataaatccatggctcggctgggttttacgggttttacaaagtcttatctgagattcctgctatggaacaaagttccatcagagcctacttaaaagcctaagtaaaaaataatcattcttgctgcattgtatacaaatagttaggccaagtataataaacaaaccaatcctaccatgatttgtctttagtaatatgcgaaactgaagagagaaaaacaaattatcttctaaaacaattgtacacctgttgttagagtctagtcttgcctattttttttcaatttttattatttttctagagtttggactgaattctaatttttcttggctacaagccttcaaaataatgttttcaatttttttccttcttttttttttctcaatttttcccaatttggagtcactgaaaactaagctatgctttctaaaaaccctgggaactgaagccagacaacttaaacttcagaaaaatataacataacctatttacgtacataagccactttcatacctgcctactattatggactgcagagtaatgtggcctatatcaattttttcaggattgttcttttgtttgttgtttttttcatcccttcctcccccatattttctcttcacaggacatgagacttcacaacctgctaaaaatgaactttccagacctaccaatctaggaataaaccgtcctagccaggaaaggtcagatgacctttcctgagactggagactcattctgttgtaaaaatgctttctccaaagatgttaaaaaagaaaaggggaaaatgtgaaagaaaaatatcttgggtcccttcaagatgggaactgctcagggcaaatctgccttctattctattcaagtcatccatttgctcacagagacagatgcatattctgattgcctcctttggaaagacttatcagaaactcaaaagaatgcaaccatctgtctctcacctacctgttacttcgaagcccccaatagggggtcttgctttgagctgtctccgcctttccggacggaactaatgtacttcttacatagtgattgatgtctcatgtctccctaaaatgtataaaaccaagctgtggccggaccaccttgggcacatgtcatcaggacttcttgaggctatgtcactgggcatgtcttcaaccttggcaaaataaactttctaaattaattgagacctgtctcaaattttgggggttcacaggtgagtgggctcaggcatgtgcactagtatgactaaaggtcatagactattagactattagtctatgaccttcctctagaaacactcgactggtaagggaagaatgcctcaactgagcatgtgcacaactcccataaacacacttgtgcttgcggagcctctcaagtgctggcaggccactgctcaggtggattcttccctcctacccggagggaagaatcaggggagaagggacacaagcccctgaatgcatgccaacacgtaaaacctcaaatcaaaactcaaaccatgcagtttaacctctcaagttgcccacttggccctcttccaagtgtactttacttcctttcattcctgctctaatactgtttagtacattttcactcctgctctaaaacttgcctcagtctctcactgtgccttatgcccctcagctgaattctttcttctgagcaggcaggaattgaggttgctgcagacgtgtatgcatttgccaccagtaacatactttggtgccacatgactaggatatgttctctagtgctaacatgttcgtttacagttcttaggactccctgatagaaaaaaacacaaaaaaaaacacaaaaaaacccaaccaaccaaacaaacaaacaaaaaaaaaacacaggagtttctcccaaaaagaagtctgcagtgtcttttctgttttctctgaaggtatcccagggtgttagatttctgttgtttttcccttatgtggcaccgaagttggcaagaagaaggaagtgctgatataaataaatagggaaatgaacagagagagtacatgtggttagcaggagtttaggatgagagaaatttagtggaccgagaaatagtctaaatatcagttttaatttgtgaaagaaaaataaaaacctgggaccccaattcactatgcctaaaggaaaaaaattaagctaaaagctgaatcatgcaagaagctgttttttcctttgttcttaagcagagcactacagataaaaaggtgaaatatctccccaggtagctactctatgttcacctgaacttatgtaaagttctgatttactgagcatgagaagaacacataattgactattcctgtacctgctccatttctcctgcaacatgtggatacagtaatatgatcataccctcccttgttcccctctaggccactttcccctttaaatattaacaccatcataatcatctttggagaaagacacctggatctgtcctgaaccttggcaaaaaataaataaataaataaaaataaaaaactcttctcaattgattaatacctgtcacagatacattttggtttacaaatcaatgaacaatggagggaactctgtccttaatcttggtacgagacaatgaaccccaggtacttaccccagacaacgacgccgcttcaccatgatgatggacaacaggcaactttttttttggagtttcagcttgcttccaacagggacggtgagtgtgaggtttattcccatttctaagacgatagaagttttcagcctaagccgtattcctaggtaagcagctggattgcagttttgtcttggaaattctccttaatgactaaaagttaagattaacaactagctggtcttaatttctccttaccattagagtacccagtaatcacataaattctgcaatcatctgtttatttagcttaactgtttttttttatttgttgaagttgttgttgttatttcagtctttttcttattgggttgaccagacttggtaaaatctgtaagaaagttccataattatggggaagatttcctctgaattggctaaattcctgtagctgaaaaaaaaaagaaaagaaaaaaacaccagcaaaagtaaaaaaagaaacattttgattacctgagaggctttatttacatggcaagaccaccttctgctagccaaactaaactaaaggagcaatggtagtcaccctatgcagtagttcagcagcaaagattctgcccttttttttagcatgacagcctgggttggttggttatgaatcaagtcctttctggtttgagatttattttacctttgaaatatcagcagcttttcccagctaaaatatggtaataatatttaaaaggattttttaagacctcaacagttaaaaggcagcttaattaaaagatagtatccgcaatccgtgtgtgtgtgtgtgtgtgtgtgtgtgtgtgtgtatgtaaaaggactttatgtttttttgtcttctaggaacgtgtttttgtaaaaaagtttttttcttctcagtcaactgaattctgctttttctatttacttctgcctgtctctcctttctcttcccaccctctgctgcatgaggcactggaaataattttaacaatggtaatgagacaaattatcaagaaattggagctgggattccttaaagaaaacagagaagatgccagactccttctgggggcaaaacctctgtttttccttatggaaccctaagagtataaacaagttcctctcagatcttaaactccttgcttctatattttgttttctgattttttttaactgaaatagttattattacaggggctactcttgggagtttagaataagaaagggtgcttagacactcaagcaacatctttgtaacaaagtaacaccataaaagcattatgtggcctagtcccatgatttctctctcctttttggagacccaggattgaatgtgggctgtgctcagagctcagagatccagttaaaacagagactacgtttaaaactatctaagtgtgattggtctctttatacaatcctgtggtagatttctgtaattttatgtttgacttggtatccattttttaatcaccctgttaacacaacagattctctctctctctttcctttgagaagtaaattttgctgattttcacctgagagttgttccttcggtatacaaatttagggctatctacctgacaattgcctagggtaatgaaacaaattatcaagaaattggagccaggcaaggtggctcgtgcctgtaatcccagcccttttggaggccaaggctggcggatcacttaaggccaggaattcaagaccaccctggccaacatggcaaaaccctgtctctactaaaaatacaaaaattacctgagcgtggtggtgcttgcctgtaattccaactatttaggaggctgagacaggagaattgcttgaactcaggagatggaggttgcagtgagccaagatcacgccactgcactccagcctgggccacagagtgagactgcatctaaaaaaaaaaaaaattggaagtctaaaataagaggggaaaaaagaggaggtcttacaaatctaagatctatttctacctgtgtgtctaatacatgtctgtatttatgtgtcatgtatatgtttcattatcaaagatatataaaacagctctaattatttggccttaaagggaaaaaaggggcttaaatcaaatactttattagaaaaatagaaaccttaagcccaaatgctttttcaagtttatgtaacttaagtaaattcttaataaataagctggttttaaagttattggtaaaataaaattagaaatatcttcagaattgtcaatatacattgttgtttagagtcattggtcaggcagtttaacatttacctctactagatattataagttgtcaaaatttggcatgaggtttataaagctagaaatgcagcccacaagagtactatatttgttggtgtaatttgttgataaatagggcatttgatatcgttgatttaatgaaaacagctaaatcctgagttaatccaggacttcttggtaaagttgactgaagctatattagatatttccccacaaaaatactatttgcattctcccactccctccctcccttgatgggacaacatcctttatttttccttgggcatacatatcattacttccaatttgaaacaagttagtataagagggagagagagaggagaggagaggcagagagagaggagaggagagagagagagaggagagagagaaaggagaggagagagagagaaaagattgagagaggggagactgttttaagtggtattatttttcccataggctgtccttgtcactctttcatggctacagtttgatcggaattagctgccagggcctccgccggcttgggctcttctgcggaggctgtgggggcccgggccttgggtgtggaactaggggcttcctggctgcggggggtctccttggaagagggggcagcctccgagctgctgcggtttgcgtatcatgctggagcccgtcacttatggtctcctgggtggcaggagctgcaggcgccttagtctttttaggtttcccttcctccttgctgggctcctccccagtggtagggtccgcgctcttggcccgggccgtggtgacttcggcagctttgggggcctcgccgccattagcagggacgggggctgcctgctctttctcggggggtcagccttggcctctgcgcgctctctgtcttctcgggctcttccttcggggtctcctccttggcagccgtggcatccttcttgccctctgtctcctcggccttgccctccgcgtcctggtcagacttcttgccctccatggcctcggcgggctctgcagctgcctggggctcactctccttcggggaccctcctcttcccttgccacgccctcatccttcttgtctttgtccttggctttctcgtcgttcacattgtagcccttcttcttgctgagtttgcctgtcatcttggagtttggctctgggtgcctgtgcagcccctgggtgagcgcggtgcccccaagaggccagggtccctggcggtgtctagctcatgcctggccgctggcggaggctctctcctggctccatggcggaggccagagcgaggagccagttgtagtgctagctccgcctttgtcgcagctgccactactgccaccgggaaaacatttttcttaaaaaatgtgttcttatggccgggcgtggcggctcatgcctgttatctcagcactttgggaggccaaggcgggcggatcacgaggtcaggagaacaagaccatcctggctaacatggtgaaacctcgtctttactaaaaatacaaaaaatttgccagggtggtggcaggcgccagtagttcgacctactcaggaggctgaggcaggagaatggcgtgaacctgggaggccgagcttgcagtgagccgagattgcactactgcactccagcctgagcaacggagcaagactccatctcaaaaaaaaaaaaagtgttcttatttaaaggaaaattatttttgtgtaatttaaaggttattcatgaaacaggataaaaggaaccagtaaataggagagatgtaaagacagatacaaatataaagaggtattctggtgtaaggaagattaaaaagaaaattattttatatgagaaagaatcttgtatggtaaatttttgtcctaaaataaaatgactggttatttagaaaagaaggatgtttagaataaaacaggaagtccaaacatgtcataagtggtttgtgtatgtcataataagggattataaaaagaagatttatgtgaaaaaaattttatgtgatcaagttgtctacaattacaaggaaattatttataatagactttctagagatctatatgaaaaatacactaatacactaaggaattggttagaacaacaaaactttcttaacatattattttaataaaattatgagattttcattttttttacaccagaagttcaatttatattgcatcttgctgtttttagctatctcacctttgagaaggacagcaatgatatctctctctctctcaactttgtcagctcctgtaaatttttcgttcaggttttaactgctattgtggcctgatactaaaacattttatcttaaagttataaaggaaatattttctcccagtataacattctgtgctttggctttaaattgttctatgaaaccaaaaatgttcacttaatgtttcctgtaacccaggaaacactcttcctatgtctaactagttcaaatacattttcattagttttgactttcaggttctctaaatagactccctatatggaaaagcagtcacactgcagagggtgttttttttttttctttgtttgacttttagtaactagactaacaaaaaagatttatgttttatcgaaataagtcctacataattgttattaagttttgatttacttacaaaaactgagttacatttatttttaaagttaaagttactgtgtcaggaattggtgggttcttggtctcactgacttcaagaatgaggccgcggcccctcgcggtgagtgttacagttcttaaaggcggcatgtccagagtttgttctttctgacattcggatgtgttcaaagtttcttcctcctggtgggttcgtagtcttgctggatcacgagtgaagctgcagaccttcgcgggagtgaagctgcagaccttcgcggtgagtgttacagctcttaaggtggtgcgtctggagtcgtttgtttctgccagtgccttcatggtctcactggcttcagaagtgaagctgcagaccttcgtggtaagtgttacagctcataaaggcagtgaggacccaaagagtgagcaacagcaaaatttattgcaaagagcgaaagaacaccgcagtgtggaaggggactcaaagccagaagttcccactactggctcaggcagcctgcttttattctcttatatggccccacccacatcctactgactggtccattttagagagagccaattggtctgttttacagagagctgattggtccgttttgacagggtgctgatcggtgcgtttacaatccctgagctagacacaaaagttctccacctacccactagattagctagatacagagtgtggacacaaaggttctctaagtccccaccagagtagctagatacagagtgtcgattggtgcattcacaaaccctgagctagacacagtgtgctgattggtgtgtttacaaaccttgagctagatacagactgccaattggtgtatttacaatcccttagctagacataaaggttctccaagtctccgccagactcatgagcccagctggcttcacccagtggatcccgcaacagggccacaggtggagctgcctgccagttccgtgccatgcgcctgcactcctcagcccttgggtggtcaatgggactgggcgccctggagcagcgggcggggctcctcaggaaggctggggctgggcaggagcccacggctggggcgggagcaagctcaggcatggtgggctgcgggtccccagccctgccccacagggaggcagctaaggccctcggagaagttgagcacagcagctgctggtccaggtgataagcccctcactgccccggccagcggggccagcttgctgctccgagtgcgggccggcgcccacgcccacccggaactggcattggcccgcaattgctgcgcgcagccccgattcccgcccacacctctccctccacacctccccgcaagctgagggagccagctctggccttggccagcccagaaaggggctcccacagtgcagtggcgggctgaagggctcctcaagcatggccagagtgggcgtcaaggccgaggaggtgccgagagtgagcgagggctgtgagggctgccagcacgctgtcacctctcattattacatctatttaactttgtgttgcttttgaaatccttgtgctgttaagttacagggctttgactccattgattcctgggtctgaaaaagacaccaaaccctgctaacttttaaacattgacagcagttaaagcctcatcttcagacccaggagaagatgacagtcaaaacaaagtgtgtttataataagacacagggacagaaattaaaactcttcaactccccaatcccagggactactgcagaagaggtgagcacgtgagattgtaagggccaattttgagaaagaaaattagttcagggtttctctataaattaaacattagtatcaaaggtacactgatgcaagaccagcaactgggcccctgtgtcagattaatatggcttttgtggagcattaatccacttttttaaaaaatataaaaggttataaaaaggcttattgaattatatcttttagtcaagttgtttaaaatttagtagatttatttataagatttgagagacatttaattggtcttgacctaatgctatctttattagagcttactgtttgggaaattaagtctcctgtctcaaagtataaagggtttggccatttatttttacatctttgagttatcattttggctaaatgaatgacttatttattttacaatgacctgtgatcctatttcgtgatatcctgtgttttaaacttttcatatttgacaaactttctaaaatcaaatactaaattcagtccttttgacctcactaatgttttgatattaggtcccctgaagtccaaaacagacatatttggcttattttctacagaaaaaaattatacaggaagcattgttaaatatgaaatggtgtttaacctactttgggttatatttacataaatgtgttattagtgtgtgtcctaaaatcatagaatattcctgtgattctgatatgtctcaatatatgttgtcagtagtaattacgattattatgtgtaaaattgtcatatgccacaaaagtaaccaaatttccttgtcagttgtgtctctaactatggctgctctacaacttttgtcatctacaattgttgattactttgatcctttcatagtgtggtttataatcagctatagaactttgtggaattcacatttagagaccgtgtaattgaaatggagagaaaatcttccaggactctcatggagagctgatgttttcatgaggattcctgatccaatattgaccagaagttaactgcatggactgaactaacagacaattgaaataatcttttatgactctttgtttaaaacatttgctgattttgtttttcagagtcaagaaaccttttttatcttttaagctatttacagcttttaacatttgagtaaagtatatatatatatatatatatatatatatatatatatatatatttatattttaattgaggcagagtctcgcactgtcacctaggctggaatgcagtggcacaatctcagctcaatgcaacctctgccacccaggttcaagtgatcctctcacttcagcctcctgagtagctggggttacaggcacctgccaccatgcccagctaatttttgtatttttagtaaagatctggtttcaccatgttggccaggctggtctcgaaaacctgacctcaagtgatccgcccagcttggcctcccaaagtactgggattacaggtttgagccaccatggccagcctgagtaaagtgtactcttatgagcaaaatttaaaacaccttctcctgtgaaagaaaaataacaccttgggaccccaaattcattatgccaaagggaaagttaagcttgggaattgagtcatgcaaaaaactatcttccttttgttcccaaacagatagctgccatttcacatgcttactttattttatgtaacgtgcaggtttactgagcatgagaatagtgcttaagtaactttttcttatactaccttctttgcacatttaaaactgttgggagcaagccccccaaagtctggccataaactgaccccaaaactggccataaataaaatctctgcagcaatgtaacatgtccataatggccataacacccatgctggaaggttgtgggtttacgggaatgagggtaaggaacacctggcccacccaaggtggaaaactgcttaaaggcatttttaagccacaaacaaaagctgagcaatctgtgtcttaagggcttgttcctgctgcaattaatttggcccatcccttcttttcccttaaaggatacttttagttaatttaatatctatagaaataatgctaatgactggtttgctgttaataaatatgtgggtaaatctctgttcggggctctcagctctgaaggctgtgagacccctgatttcccacttcacacctctgtatttctgtgtgtatgtccttaattcctctagctccattgggttagagtctccccgagcgagctggtctcggcaagtggcgtccattcgtggaggctcgaatccaggtcaaagggttgctggagcgacggttggaatggaaaactagctggaagacacccaagtactcttaaagcaatccccgtggtgagtaagaaggggagctttctgttcccaaacagatagctgcaatttcacatgctttattttatgtaaaatgcagatgtactgagcatgagaatagtgcttaagtgactttttttctactaccttctttgcacatttaaaacatagactcactgaatgctaatcaaacgtcacaagaatgtaaccacttgcctcattgcctatcctgcctctttttcttcaccccacccccacctccccgcttgctctttcctatttaaatattgaagttcccaaaaccatacttggaaaatgcatggatcacagatcctacagtaacttgcatctgtttcctaagtgtgtcctcaaccttggcaaaataaacctctagtcaattgagatctgcctcagtcacttactggtttacattttggcaacaagggaattatctgactggagtttggccctgacctgcagcaactctcctatcagggccctggtacttgctgaagctctttatcactttgaccaattggacaattggctgaggtctggaggcttcttcctccagagattgctgatctcacaaaagtttgtggttgagatctgaggtttactctgctgaagagctccttttcttagagtttactgcttctatgatgaagagcaatcttcagcttggtccccatctccaataacaaactcatttggagtttcattttgagatttggtagctgaagatcaaggtttactatcagctggctctgacctcttcttatgctcagagatcttgactgtatttaaactgtgtgatcactttctcagctttttggggttttttttactacctaagaggtttcatttacataaaaaggctgctttcccagcctctctctctgtgctattaatttaaaattttagagagatcttattctaagtaagtaatgaaaagaacagattttgaaaaggacacatagcagtgtcgcagcaagccttaaaaattctcttgataaaactaagagcaaactgtatggcctaaaacagatctggtagttaaaattctgtgacagtgttttccacctaaaatgtgctacagaggttgtgtctatgatactatttggtttcattgcaagagtaccaaaagtaaactgggtagaatccaaaggaaattgtatacaaatctaacagtcagtttatagcatttttgttgccaaattataagtaaattgtaggtatttattaatatcattccaaggaatgactagcagtgcaaaaaataggtactttagtggtaacaattatttgctaataatccagaacctacaaataacagaaggaaacagcacactcttaaataaataatgggacaaggaagaaactacaaagtcaattagaaaatactttaagattatgtagaatgagggcccaacaaacgaaaatgtattgaatgcagtgaaatggtgcataaagggaaatttattatttaaatgtttgtatctaaaaaagaagtaagggctcatataaataaacccaatcttccacatacaattctggaaaaagaagagcaactaaacctaaagtgagcagaaggaaagaactaataaaatgttaagtgaaaaataaaggagagaatacaaaaacaataggtagaataaacaaatctaaaagttggtaccttgaaaacatcaacaaaattaacaaacttttcacaaggatgagcaagagaaaaagagagaaggctcaaattattaaaatcaggagtgaaagggggaacattactacagaccttatggaaataaaaagaatactgagggaatactacaaaaaactgtatgccaataagttagacaacatagacaacattgacaaattcctagaaagacataaactactaaagattactcaagaaaaaaatagaatatctgaatagacctgtaataaataaataggttaaattagtaattttcaaattttccacacacaaaaaagctcagccctgggtggctttaatgcttaataaaaccaaaaatttaaagaagaattagtaccaattcttctcaaaaggtagagaggaggagcagacacttcccaactctttctgtgaggctagtattatcctgataccaaaaccaaacaaagatagcacaaaaaagaaaactacagaacaatatattttaggaatatatgtgcaaaaatcctcaaaaagtacttgtagaccaaatccagcaacaaataaaaaggttatattccattccaagtggagtttgttccaagaatgcaagattggtttggcatctgaaaaccaattaatataatatatcagattaacagaataaaggacaaaaccatgtgaccatttgaatagatgtagaaaaatgaattgacaaagtccagcacccattaaggataggggaaaaaacaactcaacaaactaggaatagaagagaactttctcaacatgataaagaacatctacaaaaaatgatctgaatagacatttctttgaagaaggtatacaaatgacaaataagtataataacagatgctcaacattattagctgtcaattaaatctgaatcaaaattacaatgatatatcacttcacaactgctggtatggctataataaaaaaacaaagggatactatatggtccattagttttacttccaggtgtctacacaagagaaataaaaacgtatgtccacataaaaacttgtacacaagttttcattgtacactattttaataacatccaaaaagtgcaaacaatctaaatgttgatcaactgataaacaggcaaataaaacgtgggatattcataaaatgtagtattcgggtaaaaaaatgaagtactaatacatgctacaatatggatgaaccttaaaaatatgatgccaagtgaaagaaaccaaataataaaagttcaatattgtatgatttcactcatatgaaatgtccagaacaggaatatctatacagacataaagtagattactggttacttatggctagagatgatgagagaacaggggagtgactgtaagtgggtacagggcttctttggggaatgatgaaaatgttctaaaattaattgtggggatagtcatacaactctgtgaatggactaaaaacattgtatttatatacactttaaattactgaagtgtacagaatgtaaattatatctcaataaagctgatatgtgcatacacacacacacacacacacccaacagcagaagaaaatacctaaaaggtaatgaacaaaagcattcagattaaagcatgagaatctgaaggtttggtcatctacatcttgttccatagataagcatagactgtctactaaacacagttgtcaacttgatccaaaaatcttcgctggattctgtttctttcaagactgtttctagaggggtccacaaataattatctttgaagtttctgattaggacatctttccagggattctaagattatttatgcctctttaattaaaagactttaaggatcaatatattggagttgccctcttgtgtccattattagcagtatttgatatcaactttttcattcgtgttctagagctttttctcttatttctttaagtcagaacaccagatcttcaggtttacgatcatgcaagtttttaggaagattatgagaaaaggttgcctgtgcctgtggatcataaggttgaatgtgttgcattaattccttgcaatatttcgcagtatccatttgcaatatgttagagtctacaatcagaggtgacatttgtagatatttgtgtaggccagtctgttactaatgtataagggaagagtttatgaacctcaaagaaattgatggcattgacattaaagccatggcaatacctcgggctatggaattttgaaggtttctgagagctttcctgattttagtttctgaatcttctttttttttttttttaatctttcttgaatagtgaagctgatatgggcagtgaagtttctgagtaagtgttaaggttttgtaaaggtttttaatgacagtgccagtacaatggtttttttctgtcacttgaaaaatgggttagaattttgtaggttgggaacacaaaatcaagtaatatttttgctgccattggaactgaaagtattcagaaaggaaatgcttcaattcaatccccaaaataaatgaacaatgagaagaacacgtttaaaatctactgagtgtgtagtgatcatctgtagttgttcaaacgctctctgaagcttatgctcttgttcatgtcccatttttgagttgtgcctacatgatgctggcaacagataagacatgtagttttaataaatcactaacctttatattctgcttatttttaaattataaattccatctgtgtaaatagtttctctcttcttgcactttactaaaagcagttaaaagaaaccattctgaggctgggcacggtggctcatgcctgtaatcccagcactttgggaggctgaggtgggcggatcacctgagatcaggagttggagaccagcctggccaacatgctgaaaccccatctctactaaaaatacaaaaattagctggacgtggtggcgtgtacctttaatcccagctacttgagaggctgaggcaggagaattgcttgaagctaggaggtggaggttgcagtgagccaagatcacgccactgcactccagcctgggtgatagaatgagacttgtctcaaaaaaaaaaaaaaaaaaagaaaagaaaagaaaaaaagagaggaaaaaaaagaaaagaagccattctaagttcttactgcttagagatttcttcattcgtaagttcattgctcttaagttccaccttccataaagtcctaggatatggacataattcagccaagttctttgacactttataacaagaatgacctttcttccagtctccaataccttgttcctcatgtccatctgagacctcattagaagaaacttcactgtcatgaccacttaaataatctctgagaagattcaggatttccctacagcttttgtcttccgagccctcaccaaaattgcccttagtgctcagttcatggcaatttaggttttttctagcattaacttcaatactgtgccatcctctctccccattacctggttccaaatccacgtccacgtttttaggtatttttcataacaacaccttacttctctggtaccaatttttgtcttagaacatttgtgctgctataatagaatatctagctattttaataacagagactggataatttataaagaagataaattaattctcttacagttctggaggctgggaagtccaaggtcaagatgctgacaaatgatgagagctttcttgctgcatcctcacatggaagaaggtggaagggcaagagagaagaaactaatgctaggaaatgcctcttttaaaagggacttagtcccattaacaaagaagcaggtcttatggcctaatcatctcataaaagcaccacctcttaatactatcacattggcaataccttgattttggaggggacacattcaaaccatagcagagaccactaagtatagggaagactaaacccgagaaccaagtggccagaagcctgcactagctcagctgattctgctattagacttagataaagtatgagccttttgctactgaatcaacagaaaggctgcccgaaagcagtgagtctcagatgcctcccatgaagttcacacatcacaccagggacttctactcatacgtgaaaagctagagaatcatgtttaggtaggcaaggggagagaggtcctggacaggttattgaaggactgattttaaattacaaaatacctctttatgtttagtttgcaaacaaaaggagtcaattagtgaaggcttggctgagctgatttcagaaacagtagggacccactttttgcagtagttaggaagcctcaggatctttttaaatgtatcctaattactagcctaggaaagtcttaaaagagctatagtttgttgggagaaagggatttgccttctttagaaaaatctatctttggtaatgcacttggttttgacaaaaccaagtgcattggttttgttactttcctttaaaaattctatctttttaaaacattcctggaactcatctgttctttttttttttttttttttttttgagatgaagttttgctcttgttgcccaggatggagtgcaatggtgcaatctcagctcactgcaacctccgcctcctgggttcaagtgattctcctgcctcatccttcctagtagctgggattacaggtgcccaccaccacacccagctaatttttgtatttttagtagagatggggtttcaccatgttggccaggctggtctcaaactcctgaccttaggtgatccaccttcgtctgcctcccaaagtgctgggattacaggcgtgagccactacacccggcctcacctgctctttaggatatggcagcagatcatctatatatcagataacaatagaaccacagaaaaatttaagatccttaaaattcttggttaaggattattataaaatagaatggtatttcagtaaatccctgaggcttaggagtccaggtacaatgttggttctcaattaaaatataaatcatgtctagggacacttaggaacacagaacatatatttagagctagaaaatatacagcttcagaccaggcatggtggctcatcccagcactttgggaggctgaggcaggtggatcatctgaggtgaggagtttgagaccctgtctctactaaaaatacaaaaaatttgctgggtgtggtggcacatgcctataatcccagctactcgggaggctgaggcaggagaattgcttgaacccaggaggtggaggctgcagtgagctgagattgtgccactgcactccagcctcagcaactctgtctcaaaaaaaaaaaaaatacagcctcaaataggactaaaaataagattatatataaatttggttttccaagtgtatgaggaataactatgaggctgaggtcatgaacaaatgtatattctcgcattgtttttttttttttttttgagatggagtctcactcggtcgcctgggctggagtgcagtggcgcgatctcggctcactgcaacctctgcctcctgggttcaaggaattctcctgcctcagcctcctgagtagctgggactacaggcacacgccatcacacctgggtaatttttgcatttttagtagagacagggttttatcgtgttagccaggatggtcttgatctcatgacctcgtgatccacctgcctcggcctcccaaagtgctgggattacaggcgtgagccaccacgctcgtcctcacatggggttttattattaggatggtaagagtattataaggattggtacaaggcatgatgagtccttttgcttttaggcttttgacttctggttttagactttctttagcttctgttgttagacaacattgtgcaagcttggtttttataagtttgcatggattaaactgaacttaatgaaattgtccctccccccaaattctcagcacaatttttaggcccacaaggagtcaagcacctcaaggagatcttcagtttgaacttggtgtagacacagggatactgatgaatcaatattcaaattagctgttacctacttaagaaagagaggagaccttggggatttcgaggaagggttcgtaagggagattttagctgagaaataccatttgcacagtcaatcacttctgaccaagttatcagaaaaaggagaaaagaatgtctccccactaaatgttctagggtggtgagaaatctagggtggttatctaaatcaacaatatttagatattccaatatctaaatattgttggaaatactctcctgaagtgttcattgaactctaagagagacagcttgtgtatcagtggcagggtttaaggttcattttttattcccatattaatcctttaatatttagacaaatttccttctgagtttaaggataaaatgggatgggttctgcctgggcctggccctcatggggacatcaaagggcaatgttgcaaaaaaaaaaaaaaaaaaaaaaaaaaaatcagaccatcagattgcatggggggaaccacccccataattaaattacctccacccagtcccacccttgacacctggagattatggggattgcaattcaaggtgagatttgggtggagacatagagccaaagtatattattcaaataagaaatcaaaagagaaattggaaagttcattgagctgaaaatgaaaacacgatatatcagaatcagggagttgcagctaatgtatgcttggaggcaaatttaagcactaagatcctatattataacaaaaaagaaaggtctcaaatcagtgacctgagttttcaccttcagaaactggaaagagaagagcaaattaaacacaatgtaagcagataaagaaaataataaaaaaaacagaaatcaatgaaagaaaaaagggaaaattataagaaaaatccaagaaagtaaatgctaatcattttaaacaatcaattaaattgttagacttctagtcagctgatcaagaaaaaagtaaaaaggcacgaattaccaataccaggaatgaaagggtgggtgtcaccaaatcttctacagtaattataaggaaacaatggactactgtaagccatttttttctaataaatttgataacttagatgaaatgaacacattccttggagggcataaactatcaaagttcactcaagaagaaatagataacaagagtatctattgacaaaatcaagtttttaattaaaatcctaatgacaaagaaaactaaaggcccaggtggttttcatggtgaagtctaacaatatttaaggaaacaataacaattctacgcaaatccttccagacaatagaaaaggaaaaggtctttcctttatttgatgaagatagcattactttcttactaaatcaaacagacatcataagaaacaacaacagagaccaataaccctcatgaacaatgatgaaaatattcttactaaaattttagcaaatctagttcatctatatcatgacaaagtgtactttattgcaggaagataaagttgatttaacattcaaaaatcaataaatgaactttaccatattagtggactaaaaagaaaaatgcatatgatcatcttaatagaaaaagcacttagtaaaacccaacattgagtcatgattaaaagccctcacaaaaccagggataaaatgaagagtcctcataggatgcaggccatctacacaaaaatctatgtcttcctaaaattgagaacaaggtaaagatatctactctcatcacttttattaaacattgtactggaggttctaactcatgaaataaggcaagaaaaagaaataaatcatctagattggaaagagtaacactttccttatcatttgtgtacaccagtccatggaatccatgaaataaaagctattagaactaataagtgagttagcaaggtggcagagttcaagattaatatacacaaatcaagggtatttttatataaaacaatcagaaattgaaattttaaaaatgttatttccaataccattaacaaatataaaattgttagccataaaccaaataaaacatgtggaagacttgtacattgaaaactgcaaaacattgctgagagaaattaaagaagacctaactaaatggaacatgtaccatgttcatggacaggaagacttgaagttgttaagatgtcaattctcccaagttgagttatagatcaattgaatatcaatcaaaattccagaaggcttttaaaagtgaaaatcaataattgaactttaagttttatatggaaaaaatgaaggacctagaatagtgaaaataactttgcaaaagaagaataaagttggaggacttacttatctgatttcaaggctaaatataaagctatattaaaacagtatggtattgccatacatatagacaaatagatcaatgaaacacaatagagattccagaaatagactcacatatatatggccaatagattcttgacaaagtacaaagacaattcaatggagaaagtattgtcttttcaacaaatgatgctgaatccccaaaaaagtgaactttgattcgtacctcacagcatatacaaactttaattcaaaggaattcatagaccttaaactataacatttttagaagaaaatagagcagaaatctttgtgaccttggatacaacataaaaagcataattcataagagaacaaattgataatatgcatttcatcaaaattaaaaacttccactcttcaaaatacactgttaagagaatgaaaagacatagatcaagaggacgtatttttaaatcacgtatctgtaaaggacttctatgcagaacatataaaacccttgaacctcaataataaaatgcaaacatgcaataaaaagaggaacgaaagatttgaacagacacttcaccaacagaaatattgatggcaaacaagatcaggaaaagatgcttaatatcattattcaataaagagatgcaaattgaaactacaagttgataccactacacacctgctagaaggtgtaaaattaaacagactgatataccaagtgatggcaaggatgtagagaaattagaaacctcctacactgctcatgggaaggtaaaaatggcacaaccactttggaaaacagtttggcagtttattaaatagctaaatacacctaccatatgatccagccattccactcctagagagagaaaagcatatgtctatataaaggtttgtatgcaaatgtttataacagctttatttgtaataaccaaaagctggaaccaatccaaatgttcatcaactcctgaatgcattaacaaattgcgtttactgataaaattgaagactcttcagccatagaaagaaatgggttgttgatactgccaaaaacatggatgaatcttaaaataacttcgctgaagcaaagaagccagagctcacaaaagtatgaggacatacactatgcttccaggtatataaaattatagaaaatgcaaactaacctatgataactgaaagtatgtcagtggttgcctggggacaggctgagggtggagaagtggagggaaggattacaaagggcacaaggagagactagggtgatgaatatgtttattatctttttttttttttttccccgagacggagtcttgctctgtcacgtaggctagagtgcagtggcgcaatctcggctcactgcaacctttgcctcccgggttcaagcgattctcctgcctcagcctcccgagtagctgggattacaggcgtgtgccaccacgcctggctaatttttgtatttttagtaaaggcggggtttcaccatgttggccaggctggtctccaactcctgacctcatgatccacccgccttcacctcccaaagtgctgggattacaggcgtgagccactgagcctggccgatctgtttattatcttaactgtagtgatggtttcacaagcataaacacacatcaaattttgcactttcaatatgcgcggtttagtgtatgtcaatcatccctcaataacactgttaaaaaaagaaacattaaaattaaattgtaaattatcaaagaaaaaaacactaaaagcacttttaaaaaggcataactgtaaagggactctgattagattgagagcaaacttcacaactgcagcaatcacgaccacacacagtggaacagtatattccaagtgctgatgaaaataatcatcaaaatggaatctaccctgctgaacagtgttcaagagatagtataaaatgaatgctttttaaaattatttatttttagggcggggctgccaagggaggaggaagatggcggcgggggcgaggtgaggtgttggcagtggaaaggggttcgggcttagggggcggggggacgcggagcgatgcccgcgccggcgcaggggcggataaaaagccgtagcgccacgggagtgggcgggagggagagggggtacccgagggccacaagagtatgacggggctgtaagagctggtgtggcgggtgctgcccccctgctctgtctgcaccgcaagctcacctcctggctccgcgttcggttcggcacttggaactggatctggcgactgtgccggcgcgccgcctctgccgcggtcctagcgccgctcggcttcacgctccgcaagtcccaggcgtctgcaggaaccgccatcaccacccgcacccgcgccgggggtcgtgcctgcccgcagcccaccaccaggtgcgctggcgcgcggacggcccttccctggagaagctgcctgtgcacatgggcctggtgatcaccgaggtggagcaggaacccagcttctcggacatcgagagcctcgtggtgtggtgtatggccgtgggcatctcctacattagcgtctacgaccaccaaggtattttcaaaagaaataattccagattgatggatggaattttaaaacaacagcaagaacttctgggcctagattgttcaaaatgctcaccagagtttgcaaatagtaatgacaaagatgatcaagttttaaattgccatttggcagtgaaggtgctattgccggaagatggaaaagcagatattgtgagagccgctcaggacttttgccagtgagtagcccagaagcaaaggagacccacagatgtggatgtagatatgttagtttactcagttcaaatggttgtcctgatcctgatttagtactgaagttcggtcctgtggacagcacacgaggctttcttctctggcacatcagattgactgagattgtctctttgccttcccatgtaaacatcagttatggggactttttctctgcccttcgtcattatgcagcctgtgaacagcgtctgggaaagtggtggtcattggttgcataatttgatctgaggcttatggaggaaaggacccaagtgactctgatgtttagaaagcacctatgaaaccctgtacacacctagttcataatcctcataatttatcaacaaacacaaagaagtgtcttacttgagagtgagtgtgtgcgtgtgtgcgtgcacacatgtgcacgtttgtatgtgtggaaataaacataaatggggacgtgttggagaaggaaatacatagacctacaactttgagcatatagcagtgatgttttaggaactgaaatgtcacacttaataaagtcttcagcccagctacttccctgttttcgtggggagaagggggcctgattagaactgttctggttgtgtttggcgggaggggaataaattttgttcagtccttcttagtgaccaaactttaatttttaggaataacatattgacttactgaactgaagcattctgagttgaaaggagccccagaggaaaggagttctgtgttgctcacatgttaaaagcttgctcaccttcagagcagagggaatacctatcttcagatatccgcccattttcatctcttcattatagtcaaacagtgtgacttgagagtgttgctctggtgtctgtattctggcttatgaagattatttgaaaaagaactcttactacattgaaatgcagacttttaaaaatttaaatattggattaggcagtcaaaaaaccaaacaagcataaaaggtcagtaagttgtaatcttaaaagtaaaggtggaaaactcattataaatggaagaaaagttttgatttccttttttgtttgatgggcagtatgccatattatatccaaagttggtttaaaaaatacttccatcaactatttttatttaaaataaacatttgagggaagttaccaaggcagcttttttcctcaaaagtaacctgttcctctttggaacagcacattttaggggcatggttaatacctgagatttttactcagtaaacctgatggttaccgtgtgtaaaatatctttaagtaggattgaaggcctctgtggggaatataatgttaccaaagcctataaaaataaattttacatgttcttttttatgacagagagcagcactggttctgttattttttaaaatgaataactgatttcttgacaggtgtttagtatttcttccctcactgctgattcttggatagaaaccattctttgtatttgatagactgttttcagaaaactcttatcaacaagtgtacaatagttatctaaaactgtacatttagaatggagcagtttaatactagatctcagaaatttgaaaaatagcaaagaagagtggatttggaaagcatggtctacaattgcttgtcaattctgaagctatgaagaataaatgtttcagctttggattatgaaaccccgtttatgatttttaaaacacacttgaaataaaaatgattgaactaaattttggtccggtgacatcattttgcactgcatagcccattatacattgtaagtctttttgttttaatttattactgagagttttctgtgaagctacagcatatctaatcagagaatttctgatttgtttccttatactgtgattatgttatattaaggcatttgtagtgcagcttaagactgaatttatgctttttgtaaacatgatcggtgtaaatgtcttataaacattctggagtatgtataactttaatgaatgaaatttaatggacctgattaaaataaagggatttaatctttgttaaagtgaagttagtggaataaattacctactggaatatagtccaagtcactaaaggtttaatatttgcatttttgtgcttttattttctccttccattcataattatatacttgaaagtacatctgtagcctatgacttgagtctcttgaacttctaggaagaggcaaactacaaactactaggattctgatttcagatataggcattccagaatcttctctttacgagttcacctgctagtataatctccacaacttgaatggccttggttgttctgtaattgctgccaaaatcatcacaagctgtacgtcatcaaggctccctttgcactcccaagaagaactgttcattttaaacaaaagtgtatgtctttatttgtattggaaaatattgtctttaaattgtttcttgttgacacttcccacaatggaaaaattaccaaattaaacctgttttatggatggcagcttggagcatagcaagaagttggaggatttgaattccattcccagttctcattgcgttttgtttcttaaaactataataattggttactgttataaagtttaaaaggtggttttaatatgaatagcaaattctggtatattgtgactaacgcttaagaatgcctgtctttgagaggaaggtgttataatattaatcaacagtgccaaatacactgtgcatatctacaatttaatctttgaatgtttgttactggattagctccctcctccttctgtgtgatggtaccatgcatagagtcaatcaaatccttgtgatgttttgtatggactttgacaacatgtaactaatgtgtaaagcaagtttttatgattaaggaatcaaatttattgaattttattattgaaagttgaaacttaacatgtataaacaaaaaacaataaaataataaactattttcattgactataaaaattatttatttttaaaaattcatacataatactgtatgtatttgtggggtacgtattggtgtttctatacatacaatgtatagtaatcagatcagggatattagcatatctgccatctgaaatattgatcattttttgtgttgggagaattcaatgtcctcttttagctatttgaaaatatatattcttgactacagtcatcctacagtgctataaaacattagaacttattccacctaactgtaattttttgtcctttaacaaatctctccctatatcccccttccctttccacccttgaataacctggattctactctttacttctatgagatcaactattttagcttctatatatgagtgagaacatgtttaacttcctgttcctggctcatttcacttaacaccatttcctccaggctcatccatgtttccatggaggacaagaattcattctttttattgctgaatagtattccactgtgtgtgtgtgtgtgtgtgtgtgtgtgtgtgtaggtgtgtgtatgtgtgtgtataaaatcatattttctttagccattcatctgttgatggagacttgggttgactccatagcttggctattgtgaatagtgctgcaatggacatggagtatggacaactcttggatgtactgattttctttgctttggttctttacccagtagtagggctgctagatcatatgctagttctatttttgtttttttgaggaaactctatactattctctacagtggctgtagtagtttacattcccaccaatagtgtgtaagaattcccttttctccacctcctcaccagcatttgttttttggttttttttttgtatttttgacaatggccattctaactgaagtgagatgatacctcactgtggttttgatttgcatttatctgatgattagtgatactgaactttttccatatatttgttagtcatttgcatgtccttctgagaactatctgtttgaatcatttgcccatttttaatttttttttttttttgctgttgagatgtttgaattccttgtgtattctagatacaaatcccttgttggatgaatagtttgcaggtatctctcgccctatgcagaagttaactcaaaatggatcaaagacttaaatgtaaaacctgaaactataaaaactactagaagaaaacacagggaaaatgctttatgatattggtcttggaaaagattttatgaataagacctcaaagcacaggcaacaaaagcaaaaataaacaaatgggattacataaaagtaaaacgcttcagcataccaaaggaaacaatcaatgtagtgaaaagagaactaacagaatggatgaaatgaagactttcagaaccaaaacatcctgagagagtgtcccactgaagacctacacacaataccctactaagaggtattctttgaccaaaagtaaattgaacctgggaagatggaataagatacatgaagctcgggtgagcaaagaaaatgcaagataatacaggtaaatctaaaggagcactgagtgtgtaaaataataataatcgtaactaataatgcaggtaaaaaaatactactgaactaaaaccttatagaagataaacactaacttatgatttaaggagaacaacaacctcttaacctaagaatacaagagaatttccttatcctgataaagaggattaaatcatatagaaagtattatctttcattgtaaaattcagtgctgctctaaaatcagctccatttttatgtttcattgtgctagagaccctagaagcagattgtgagataaaaagaaatctgttattgggtctaggaaggaaaaaaactaagctattactatgtgcagaacatttttgaagaggaaattaaagataatctagagacagctgttagaattaactagggagttcaatgaattgcaggatataaattcagcataaaaattactagcaaaaattagataagtatataagattccattaacagtgaagaaccccacaaggttcctagagatacatgtaataataatgtgcaagacgtttctaataggaggaaatgggtaaactttgttggaaggcatgaaagaagacctaagtgaatggagaaatatgccatattcatgaatagagagactcgttaatgatggaaactatcattacattgatctaaagataaaatgtatttccaaaatcttttcccaaaatgtgtttttcatgctgatttacaaaattaacatacaagagcaatgagccaaaaatagccaagacatacctaaatataaaggcgagagagataacagatatcacaacttattttatagagctacaagtcttaagagagtgtgatatggttcagagatgggtaaataaaataatgaaactgaggctacagctagaaaaagaaccatgaatacatgtgaacttggtatatgatgggggcattacccttcaatggggaaggggtgcactacttggcacgtggtgctggagcaacagaaaacaaattcatcaagaaaaaataaatcacaggtaggtcagcacctacacgtgagaatgcaaagctataaaagataacatgagtttataccaatatcacaaaacaggaggaacagtttgaggtatcagacacattaaaatttaaaattctgttcagaaaaaggcaccatcaataaagcaaaaaaatgtacaagcctcagtctgagaggatatatttgcaatccacataaccgatgaagtatcactatccagatacataaatagttctgaaaatcagtaagaaaaaggcaagtgacccaatggaaaaatgagcgaatgataagaaacaataaatatcaagagaaaacaatgggcaataaatagtgaaaagaggctgaacttcactgctaacactgagaaacacaaattaaaacaactagatgccatttttcacccattagagtgtaaaaaattaagaagtttgatactacagagtgttgccatgaatctgtggaaatggaaactctgctgctggaaggcgtataaactggtataaccactttggacagcaatgcagcaatacctaataataatggtaatgatagcgctaatgtttaatacttattgaacatttataaagtgccaggcattgttaaaagctggcatggaaagctgatgacacacattcccagaagccaggggctcttcctacagtggcctggcccaaggacccctgcacatggcaccagcagacacaagcaaggctgctcatggtgtggtgggaaagcagaactcgtttgtaagttcctgagtggggaaggatcactaatctgtgcctcattggcacaacagaatattctactccagctaacagaaacacactgaattgatgtccgtcaatatggataaatttcaaaaacttgattttgagtgaaaaaaagcaagttgcaagaatctttacaccatttggccatttatgtcaactttaaggcacataaaatattgttggaggatgcaagcatgtgatagaaaagtacgaacttgtaggtgggaaatatggacaccagccctcctccatagagagctgacagctagctggggagctagcattggtccttctgtccatccatccacaggagccaggccatctccaaggagggaacaccggctaagggaagcaagagccagccttgaggagctggaacctggaggaaggttattctaggaattcaaggacttaagacatttgaaatctactaacctcatttgttatgattcattatacattaaaaagtcaggaaacagcagatgctggagaggatgtggagaagtaggaatgcttttacactgctagtgggagtctaaattagttcaaccattgtggaagacagtgtggcgtttcccaaggatctagaaccagaaatatcatttgacccagcactcccattactgggtatatacccaaaggactctaaatcattctaccataaagacacatgcacacgtatgtttattgtggcactgttcacaatagcaaagccttggaactaacccaaatgcccattaatgatagactggataaagaaaatgtggcacatatacatcatggaatactatgcagccataaaaaaggatgagttcgaccgggcgcggtggctcacgcctgtaatcccagcactttgggaggcggaggctggtggatcatgaggtcaggagatccagaccatcctggctaacatggtgaaactccatctctactaaaaatacaaaaaattagccaggcatgatggcgggtgcctgtagtcccagctacttgggaggctgagacaggagaacggcatgaacgcaggaggcagagcttgcagtgaaccgagatcatgccactgcactccagcctgggcgacagagcgagactccatctcaaaaaaaataaataaataaaataaaaggatgagttcatgtcctttgcagggacatggatgaagctggaaactatcattcttagcaaactaacacaagaacagaaaaccaaacaccacatgttctcactcggaagtgggagctgaacagtgagaatacgtggacacagggaggggaacatcacatactggggcctgtcggggtggaggggaaggggagggatagcattaggagaaatacctaatgtagatgacgggttgatgggtgcagcaaaccaccatggcacgtgtatacctatgtaacaaacctgtacattttgcacatgtatcccagaacttaaagtataataaaaaaaatttttttaattaaaaaaaaaacatgggctcaattaacatgcagccaaggtaacacttgttaaaaatcctacctccatgcaggatgagaattcctctggaggtgggaacagagaaaacttcatgcttggtaaagcacctgaggcacccattacaatctgggacaagatgaggacatcaacactcatgctgtattccacatgggaggccaagtcaactcaagatgatttttaagagatataagagccaggcatggtagctgatacctgtaatcccagcactttgggaggctgaggtgggaggcttacttgagtccaggagatcaagaccagcctaggcaacaaagcaagaccaagacgccttctctacaaaaaaataagaaaattagcctggcatggcagtgcacacctgtggttccagctacactagaagctgaagggggaggttcacttgagccccgagtttgaggctgcagtgagccacattagtgccaccgcactatagcctgggtgacagagcaaaagcctgtctccaaaaaaataaataaataaataaaagctataaatactgcaaagaggcaaaacctgctgttgtttgctgacaagctaatcatatctagcaaatccaagaaaaaaaaaacagtaaaaaatgaataagagaattcagtaatatagtcagagatgaggccaacatataaaaatccatgtctttctatatacacaagaaataaccatttgaaagaagctgtcctatttacaatagctagaaaaactgtgaaatatctgggggcagaggttggaagaaacaaaaatgcacacaaaacttgtgagaggaaaaccaaacctttattggcaggcacaaaataaactttctgagtaaatggaaaaacattctcttcttgaatgaggaaattaacattgtaaagatgtcaacggtctcccaaagtgatcgagatgcgccctgtgcagtggaatcccaaactgtaattgcatctttcacggaatttgacacactgactgaaattcacctggaaaagaacatgcttagtaaacatggtttcctgagggggaaaaaaaaaagaaaattggttttgcagacaaggttcaagttagagatcccagaaagaaacggatgtatctccatgcggtgaggtacgctgggaagggcatgtcccgcggaaagagcagggtggacgatggaccgtctggaaaacaggctgccaggggacagaatcaacacagatttccaagtcacaaaaacacgtaaattctgtggattaaagaaagatatctagagatctacaaacacaaatctaaagaatccttgatttcactgaaaatcaaagatgttgatgagggtaatcatgagctattgtttttcactcataaaattgggggtgaaagacaaggattaacctttctagcgatgataaaggtgtaaaaagtatttggctgcgcggctggtggtgaataatttttacaaccttctcagaaaacaatatggaaacgtccagcacaagccagcagagaaagcctgtttgaggcctctgctgtggatagggacgcctgcctgaacacaggggaatcatgcgcatccatgctagctgcagtcattttggtaatagaaaaaaaaaaaaaaaagaattagaaggggaaggaaagagaagcaccttaactcttcgccggcagagatcttgttacacagcagcatcgccccacagggcagaggcctctgcagccatcaaagaaaatgagatcgagctaagtgggccaacgtggaaagctcccgggacatggtgttatatgtaaaaagcaagttgcagacgacgcatgaaatatgtatgattccatttgtgaaaaagcagcatcgctagaaaaaaactgtatattttatttcgtatgtacacacagtgtgtagatccatgtaaagaaagcagtccagacggtggggcggggttggagatgcagccagccctgctttgtgtctagatactccggcatgcttggcgcccccatgcccgaggtcatgtgctcctgccataatttaaacaaatgcctgaacagcaaaatgaaattagaataggcagctagacgtggtctggagcgcaagaggaaggtgcggtgcggtgaggtgagaagagagaccgcgctagaccaggcgatgtcttagggacgggagaggggtgaggcccacggcggtcctggggagcggcccacgaccggcccacgcagagcttgtagccagtgaacaggaagtattggcgagagggactgagaaacccaagagagtgtggggtgaggaaaaggtcaaggaaggcccaggcttccaggaagggcctgggccggggcggggcgggtggtgggaggcagtggttaggacgggcgggggtgggggtgggggtgggggtaggggtgggggtgccacaggaggccggcgtggccttggaagccgctcagccgcgcgggggagcccggggatccgaggagctgcggagggaaggggaggagcagggcgtggttggaaaggcggtgggacagggagggctgggctgtgcggctgtcccgtcctcgtgaagaggagcgttgggaggagccgggagagacaaggctatgggcggcgggcggggacggctgtccctccctcaaggagtggagttagcgaggctgcgctggggtgctccgttgccgaggatgggccgagttcgaggcggcaaaggtgcgggtgtgcaggggggaggcggcgccctcctcgctgggtctggggtcccgcagcgcctcgggccggagcagtgagcgagcgtgggtgggagctgcggcctgggtccttgagcccggctgccccgacggcaggtgcaccggggttgcgggggactcggcgcatctccagggcgagtgagtccagggccttcggcctacaggctgagcaacgcggacaacagcgagggggctccgtggcacagctggcggggtcacggcgcacgcctgggcgccctggagcccggagactcagcagccatcgctcggggctaccacggccctccaggctcctgagccacccgcacggaggacgagctgcggagcgcggtgtgcggatagccaagctcctgccgccaaggccaccccgagcccaggctgccagggcggcatccacagccggcggcccgcgggcctgggcctgagacccgcgcagcagccccgcctgccctgccgtgagagggaagtagaccgcgcttggtttccgcaggttagagtctcagatgcattgttacagctgcacaaactaccctaccccgacagtgcgtgggtgccggagccttggtccataagggagccttgtgggcagtggcttaggcaagagcctgactggtgtcatcctgtccacttgtttactaaaaccctctgctgtggtcattcattgctgaccattcacataggacagacatatcttcatgatttttgcccattcgcgaggcctattcacatatcttttccccaaatatcttcaccaccaatttttccaatcgttctttccatgtctctgaccatccagcataaacattgagcacagctggcgaaatagtccatcactgcacaactggccactgctccttctaagcaaagtgcacagccaggtgcactgcctgcagctctgcccaggaggacttcccttccccactgtctttcagggacgtcccaggaaggggctgtagttctgcagcatccactttcaggtggtgcctgcatatggggcagagccgtctgtaaaccaggcctgagtcatctcttcctctgtcagatatcatggggacctccccaggaggtcacaggctcaggctgggagagagggtctcagctgagaaaggcggtggggcaggagtggggaccatgggcacttgggccactgcttcatgtaacctacttgagcattcaggggctgattgggcctaatcacatacataccacttccattcgatgacagagtgttgctgtgcacacctaactgtatggcttgttgggtcagataacaccctctgacaccaccctctgacacatagacgtctcaccgataaatgtagaatagttgctacttcttgctcactaagtccaatcagcatgatgtcatcaatgtaatgcaccagtgtgacatctcatggaagggaaaagcaaccaagattcctgcagactaaattataatgtagggctggagaattgatgggacactccctgaggtgggacagtgaatgcgtattgctggccttgccagctgaaagaaaactgcttctggtcagccttctggacagggatggacaaaaggtatttgctagatcaatagctgtgtaccaggtaacagaagatgtgttaatttgctcaagcaatgaaacgacatctggtacagcagctgaaattggagttaccacctggttaagcttatgatatttcagtcattcttcaagatctatctgtgttccctacaggccaaataggagagtcaaatgggaatggggtaggaatcgccagccctacatctttcaagttcctgagggtggcatgaatctccacagtccttccaggaatgtggcattgtttttgacttacagtagtcaccccttatccctggtttcactttccacattttaagttacctgttgcacagtacaagatattttgagagagagaaatcacattcgcatagcttttattgcagtatattcttctaattgtttgattttattattgttgatagtctactgtgccaaatttataaattaaactttatcatcagtatgtatgtatcagaaaaaacatagtatagctaggctttggtggtttatatgtccatagtttcaggcatccactggggtctcagaacacatcccctgcagataaaggggggctactgcattattttcccaggctaaagcagttctagtggcttctgcttggtcttcttcactgtaatagtccttactccacaggtcaggtacccagtgtgtagatgctaccagctcctcagtatgcctcttccaattatgcattctggaatggggaaataactacaggatgggtttggggacccacttgacccactgtaaaatgaacctgagctaaaactccattgatcattgagctccataagcccctactctgcctgggtggccacagtgaccttttcaatcttctggaatcaatgtcagtgcagatccagtgtccagtagtccctgaaaggtctgagtccctgaaaaggtaaggtaggtccctttggaggaggctggggaaaagattaagagtatacatttcgggtagtgtaccagggttgttttccaaggcgacattgttgtcccttcattcacgagttccaagtctgtaaattggctcaggtctgagaattgaggggctgtaactctctgctttgagagaatgattttatgatttgaatttgacttctgttttagagactgggtctcattatatcacccaggctagagtgcagtaatgtgatcatagctcactgcagcctcaaattcccaggctcaacagatccccctgcctcaacctcctgagtcactgggaccacaggcatgtgctgctatgcccagattcgacttagacttttattcacttgatctaaaacttttctgcttatacagatcacggcttctaatcaaatccccttccaggagccccatgataacgggccagagccatgagtctcatgagccaggctgttctgattgctgctgtgccactcctgcccattgctatacccgcacccacctcgctgtggccctgacagctggatccagttgcttcccttgcacttaggtttccagctgagtggctgtggttcccaccgtaaggtctgacctacagagaagagttatggcagagctcttcaaggaagctggggccccctcacacagttctttctcaaggtgttagtgaaaggctgtcttccagaccccccagcgtgggtgagtaggtctgaaatgacaaacccactctaacacatcagcctccctagccctttaagctccctctacattaaacttggggagattggatctttccagtttgctcacagcagggcagactatcttttgacccctgttcagccatccaaccaaacttcgccctttctaactcactgagctgcaactttaaatccacaatatctgcttactgagcccatatcaataaatttggcctgatccaactttatgttccttccactaccatctcacatccttaatattcattctcacctgtgttccctggatttccacttgtataaattagaaacccatgttgttcttttggagtgcaacataccttcttgtgggtcacaatttgtccctcaccttcaggggccttctggggtttgggtctagttataggtctagaggcaaagtggggtggtgaggctgggtcctgaaaagaatcagcattgtcccactttgccaccacctcagaggaagatatgactcaggatgcgggggactcccacaaatcaggtggaaaggctataccagtattggcagggatgctgctgccactggggatgtgaaggccactttgtttgagggttggggggacctcttccactggcaaagaatacatcagaatttaggagctcgatacccccagcttcatcagggtcttcccacatgtccccattccaacttacagtatcccattctttcccaatccatttccccacttaagagtagacatcctaggagactgggagctcaacttgcattgaattaataatttggccaattgctggatgagatcctgagtttgattttcagaaacttcagccctgtgcttgtatgaaataaggctcttggggcacacatagaaactcttaggtcacttttgtggctcttgagctgggaatttgaatccctgagctcatctttttcttttaccactttgtgcaatgacattagaagcaacaaatgtcattatattcctcagttttcctaaaatgttcaaaagtatcatatacagagtcatgtagctccttgcttcttataagtggtttattaggaggatccaatgcagatagtttgcatatctctatagtttatgccatgggtgatcagtgctctctttactactggaagtagaatcattagtgtctttacatatagtctgattaaagatccaattccagaaactccaggaagaattcagaaaactcatcctcaaaattctggtcctctagatccactcttggtaccaaaatctatattagagttctacaaagaaacagaatcaatagaatatgaatatatataaatatatatacatatatatatatagagagagagagagagatttattataggagttatgtagttacggaggacaagaagtcccacagtctgccatctgccagctagagacccaggaaagtcaatggtgttattccatctgagtgcaaagactagagaaccagaagcaccaatgttcaagggcaggagaagatggatgtcccagctaaagaagaaagtgaattcacccttcctcagccttttgttctattcaagccctccatggattaagtgatgcttgctcactttgaggagggcaggtctgtactcagtctactgactcaaatgttaatctcttccagagacaccctcatagacacatgcagaaatgatgttttatcagctatctaggcaacccttaatgcagtcaagttgacacctaaaattaaacatcacaagcagggaagatggtgtgggaggtgaggtgtgtctgtgagcagaagctgggtgggtctctgcatgaacatgtaggtacgggtgcaagcatgtgggagctgttggtggcaaaactcaacagaatcaactcatatttaggaagtgaatcagatgtcccatcctctgagccctgtgacatttcatgatctggagcaataaaaaactctcagagcaagatgtataataaaaagctaaattttcaagtatggtttttggaagaatgtgacttctgacttttaacaaaaagcagaaacaaacactttctttcatacttaggaattgtctgccaggcttctggaggcacctgggccgtgtgggttcacagcggtcatccagggaatggatggacatggtgagtttctgaagcacgggcatcacccttagggtagggggagggctccaacaccaaggcccccagcacacatttcacaaggaaaaatgaccgtgtcgtgcctgtgttggtaggtgatcaactgtgcttaaccgagaagggaattttctctagttagaggcctcacattaagcatgcattggcttcatctggagtgtgcagaacagaatcattctcttccccattcctcaccaagaacagtaattagaatgcaagttcatctccatataatgcattatgactttaatatcagtaaatgcttcttacatattagatgcagtgaggaaatattagttgaaaattcacagactggtatgatcagtttcctctaggataaaatgtgataaatgggttttaataaactgaggagaattataggcaccatcatcttggttcctgtcaattttacttagagtaaaatgccattgcaataattagttggtttttactgtattcattaaaagtttttctaatgaccacttgaggaataagtaaaattaatttctttcttgaacatcaaaggaattcatcaatcaaacaaaaagcaaacttcagggattatgcgagacagggtgaggaccagtggttttccgtgcccactgtggggacagcgctttcccgccgtatgtcattggcatggaagctcgaggccattcccccgaggtgtgctgatggagagggatgcaggccccgggtggaggccctggccgtccttctcaggtgccattgagctgtgactccaaggcctcctcctccaggcagctttccttgactgctccaacttcagggctctctcctgcctggcccacacacttgaactagggctcctcagtctcagaggctgaggccagtttctctctctgcctgtggcccctcagattccagcatagggccaggcactctagagggctcaagggccactacccccgtcctagctcctgcagtgctcggccaagctcagcccttgttcagcacaccagccctgtgagccacgctgtccctggagcctggctcggaggatgcgaggaggattctccagcaggcaagcatggtcagaggggccactgggtcgccagatggagtccctgtgccgatcccacagtacacggagaggagcagaaaagcgggtgaggcctggggagatgacatcacatggctggggctactcagtggtgaagggagagacaaagccggacaccgctctggctactggggggagcaatggtccttcccacctcttgtgccaggtacagcactggggcctgggaccaggacgagcctcagaacacggctggtgagcacacccacctccacctgcacccatccccgctccccacacacaccacacacacactcatcacacacacactcatcacacaaccacacactcatcacacacgctcatcacacacaccacacactcatcacacacattttacacacaccacacacactcgtcacacacatgctcatcacacactcatcacacaccacacgctcataatactcatcacacacattcattacacacatacaccacacacatgctcatcacacacattctcatcacacacaccatacgcactcatcacacacactcatcacacacatgctcatcacacatgcatcacatgctcataacacactcatcacacacatgcaccacacacatgctcatcacacacatatcacacacagcacacacactcatcacacacgctcatcacacactgatcacagacacacgctcatcacacaccacacacacagtcatacaaactcatcacacacaccacacatatactcatcactcatgctcatcacacacattcatcaaacactacacacatgttcacacactcatcacatgcacaccacacactcatcacacacattcatcacatacaccatacacacattcatcacacacggcacacacatgctcatcacacacacaccatgcacactcatcacactcacacacacatcacacacgatcacagacatcacacacaccacacacatgctcattatgcacactcgtcacacgcacaccacacacagtcatcacacacacatcccagacaccacacacaccacaccatatatacactcaaccatcacacgcacacacaccacacacacacacctcatcacgcatacacctgcacacagagccacacacactgggccatcacacagacaccatgcaccacacacacacacactcatcacacacaaacccaatcacctcacacacccatccacccccatcacagcccccacctctgctgaatggagccccaccatccttcaatgaccagctggcacctcgtccttgacgtgccccatcgcacttccttctcccgcccacgaggacctcggtaatgtcgcccctgaaactgctgcggaacctggagcccactgtaacccagaattggaatcccagctcagcccctgcacacctgattgcccggagaaatgccttattcctgacagcctcttggttcttttccgtctccggttaggtgagaaggtcaatctggccctgcgggttatgttgggggttacatgagaacctcattggcatgaagaggccaggcaggtcctccgacagtgccacagccccaggcttgtgccgccaaatcacggaggccttccgggccctgaacacgaaccggacggggccttcccgcattactacccgaatgacactgctggggggaccgctctctggatgccattgtggccacgtgtcgggacggtcggctgcttgactccacgacttaaagctagatttggccttttaagcctctgtctcagtgccctcgggtcccttctgcagctcacctacctgtccctcggcctctggggtgggctggcagggctcgttctgggacctacgtggggtggcagcaatggctgtcatggtgcagagccggcttctcggagtgcctggtctggggatccccagggaaggcactgaagctgtctcctaggctcccgggcctgtgaggcccagccagctccacccctgccccacccaccccaagccccacaggggtcccctacctggcagctcaagcccagccccctttcctggtaccctgagaggccccaccaccacctcgtgccagtcaagggtgatgtgtgggccgctgggcctttgatccctgtcagggtcactcagagaagcctgggtgaacatgaaagttcgatgctaagccacatccaagccaagactcaggaacaagcagggaccttgcctgtagtgtccccaactcctgagcagctctccagcttctggatcccctggctctttttggctgagggggctcctctgtgtaactcggccaggccctctttccaggcttttattcttcctgcagccagagaggggggcagagggagcctctggtgccagctctgaggcctctcttgaagcccagcctgaaggtgtctgtccccacctgctgctacccccaccctgagatgggggcttagaacctttgccctggtggcttgccctgctgggaccccttcttctaatctcagaatgaccgacccctcgcctccctcacgtcgctgtttcagagctactttctcacccagatccccgacctggtgctcctagtttccccacccacctgtgctacgtgttcccaggtgtctgccacctgcagcaggctgcccagtcattcctccctccccgtgtgctttcatcatcgagccccttctggccccatcctccagctcccgccgtgttgctcagagcagctcacggtgcacggcgactccggggaatggggttcccacagctccccggcttccataaaggccacggcgggctctgcagggcaagctggcctctgcgatcactgcgcagtgacccctcacaagtagcatttttgcacttgggagtctacacgttttttcattttaaaaggagtttgtccctgctgtttgagaaatatgcccaggaacacagcccttctcagagagtctggttacttaaaaggaaagctcttgattacataggggagttcaccgtggtgcaatgttgacggaggcatggccagcacagggcaggagctgggggactgacacctctgaggacaggtagacactcatcatagcagcaacacactgcttgcacctgcagaggccacaggctcagcagagctgccctggcgatgctggtgatttcaggaggtctctctagagtgccgggagatgctgcaccctcagaagtggccgccaggagtggctctggcagattgagatggtgatttagctgatcatgccgccgtccgtgttcactctccatcagaagccacacctcactctcttagagcgagggagagacacactcaagctgggggcaaatggcatctgcagagccagatccaggggccaggaggatcggggactccccgggaggagtctccatgccacgtgagtcaatcagggaaccctaattggaaagcagtaatacaaagtaattgagtttaatacataatttagatggttactcgttaagctaatgcctcccgcttaggtgtggggagaaaattatctagtagacggggaagatttcatttgtttttataatggtatgctcgccaattgactttagtaagagcagtttgttaaatcagattttgaattggtgcatagatttgaagttcataagttagtttttgatgtgatatacttagcgcctcccttcttcccttaaagtggctggatttattctcccatgaggctgtgcgctcattgttgtcctgcattatggaaattacatcagttctccgtggtgtcttcatgagaggcaattttactcctgacttctacctgttttttttttttttaatttaggaagggacattaaagagactctgcttgcttctttgcggggcctttttcctcttgaaaacagtcccagggctgcaaacaaatgctttggttaaatatcagaaaggaacttactaacaactccttactagggtccaaccgtcattcattaacctgtctgattttctcagcaatcctgtgaagtcaagcggccgctaggaacccagctcctgtgtgtacacatcgaggccgtgggcctggtcacgatcggtagctgggtgctggcctggcagtggggaccaggccacacccacaaagcaggtccgcctgggcctggacccaagttcatctggccagcccagtgatggcgaccctgactcagtttccctatcaacaaaataggaataagatactgagtacctaaagggttttaggatggaaggaggcgatgcctgcccacggcacgtaacagagccagtgccaagagctgagctgtgggcactgcaactaccccagtagaatggctcctggacccctccccgaaccagctccccctcctccagcagccataccaccaggccgacagcatctgacccatagggccccaccctcacgcctgcttctcaccagctttggggactccagtgggcatccctgttctccaggcctcagcatcctcagctatgaaacaggctgctgaggcctcccttgggcaaccagcatcccggccgcaggcagaggggaatcttgctgacaggaggcaggagaccaccccaggaaccagggtttgcccggtctcctcttggggcagctatccaggcagaacctcagccctcagatagcaggatcacggcgaaaactaagtcatcatgtgtctgaaattggtgggttcttggtctcactgacttcaaaaacaaagccgcagaccctcccagtaagtgttacaattcttaaagacggtgtgtccagagtttgttccttctgacattaggatgcatttggagctttttccgttggtggattgctggtctggctagcctcaagagtgaagctgcagaccttgcagtgagtgttacagctcatagacacagcacggactcagtgagcagcaacaagatttattgcaaagaacaaaagaacagagcttccacactgtggaaggctatctgagcagcttgccactgttggctagggcagcctgcttttattcctttatctgaccccacccacatcttgctgattggcccattttacagagagctgattggtccgttttgacagggtgctgattggtgcatttacaatccctgagctagacacagagcgctgactggtgtatttacaatcctctagctagaggtaaaagttctccaagccccgaccagataagctagatacagagtgctgattggtgtatccacaaaccccaagctagacacagagtgctgattggtgcatatacaatcctccggctagacataaaagtactccaagtccccaccccactcaggagcccagctggcttctcctagtggatcccgtgccagggccataggcggagctgcccaccagtccagtgctatgtgcctgcactcctcagtccttgggtggtcaatgggaccaggcactatagaacaaggggcggtgcccgtgggggaggcttgggccacacgggagcccaggagttgcggcgggggcggtgttgcttgggcatgggggtgctgcaggtcccaagccctgcagcatgggaaggcggctgaggttcggcgagaattcaaccacagcgcgggtgggccgtcagtgctgagggacccggcgcaccctcctcagctgctggtctgggtgctaagccccttactgcctggggccggcggcaccagccggctgctgggagtgtggggcccgctgagcccgcgcccaccaggaactcatgctggcctgcgagcactgtgcacaacctcggttcccacctgtgcctttttctccacacctcccagcaagcagagggagctggctctggcctcagccagaccagagaggggctcccacagtgcagcggcaggctgaagggctcctcaagcgtggccagagtggactccatggcctgaggagttgccgagagtgagcgagggctgctagcactttgtcacttctcaatcaggaccccaggcctgaaggtcatccctgcctggttcctgcagcagcctcagtgacaggtgctggggaaggccctgatgcaggcagcctttatcttggcctcccttggacccccagcccctccagctccagtcactgtgttccaatagagaccccccagggcactgcagggagtgctttccacagccccagctgcaccccacttccagcttgcctctggaaacagccacgaatggcagggtggcaccagaaggtaagcctttagggagaatgaacacaggtctccaccctcagacaaacacaggcctccaccctcagacaaacacaggcctccaccctcagacgaacacaggtctccaccctcagacgaacacaggcctccaccctcagacgaacacaggcctccaccctcagatgaacacaggcctccaccctcacatgaacacaggcctccaccctcagaaacagaagctccacagagcccccaagggaccctggggcaccctggaagcatccaatgtgcactggagtcacctcaagagccatggggacttggagccgcttgattctgggaaagctctccccgatggaacattggaataaatgtgtgtagctgtgaaacccccctttgcataaaatcaaaaagagagcctgtgtaaaacagatttctaaatacccaagaccttaagacacagcctctcctcctgggcacctccacagcctcttcctgcccttcttgcctccaagccggtgcagctccttctaaaacatcttggtgcacccagggtccccagaggaaggcgggagcccacgggagacacgtggacaggagtcagcccctccaccagcctgccgggaggcagatggtcgggaaaggggtgccctaccactctactacagaagaatctgttaccatggaagcatccggagcaataaggaggaggtgactttgctccccaggaagtggggccctctgccccagggatgggtgcgctcgtttgctaggagggccgttcagactgaggcacctggggtggggggtgcaaatcctggtcttgtccccaagggccctgggcatggatgccttcagcaaactctccccaagacccaggcatggggcgaggcaggacctgtcctggagctcccaggctggggcagcagggagggccaaggcgaggggccctggtgtgtgggaactgccccaatcaccccccagtccctgacctgaagctgcccctggggctgaggagcctcactctgtccctgggccagggtcccgggctccccagcctgtggagtgagagccgcagggcagggatggtcaagcaccaccacccatggctgtggccccagccccatcgcctcagcctccagagcccccaagccttcacccagccttatgggccccgctgcccacaccctggttcatggatttgagccaagctcacccgtctgcccagtggctttggattcaagagtgtccttggctccccctgtcccccagccatgtctcatagtcccctggggtaggctgaaggtctctgagggaaacccgctttcactgtgtggagcacaggccctggcccactgcgggcccacaggactttctaggaggaggaaacgccttctttcttggcttctcgtatgctcccgtgtgggccatgggtgcgtgtggctggcgcccaatgtcagttcctttcattcacttccctctaagcacctccgtggatgagcagccaccgtcctggacacacacaaagtctcagctggcgtgtggcaggctgtggggagctcagcccctccactcagacgtggtggccgtggccactgtctcgaacaaaaggaagagcttgtttacaaattgttcattgaaaattgagttgcaaacattggcatcaggcctcgcctgccaggccacctggattggagggtaacttatgaagattgctttacctgggggcatgctggtctatgcctgtgagtaattcacaccaggctcatttcagatgcagtcaaagacccccatatttcaccacaacaatgtaatcacagagccacgttaaaaagtcattactgtttagaatccagcttggtttgaaaaacacttactataaaattcaacagcctttgtaaattaccaaaaggtttacttaagaatcctaggtgccgtgatttagaccgggaacttaccactttattaattctgtgggattttgtcggtccctgcatttataaggcatgattagtgagtgatgagataataaactcctccgtgctggttcggaaataatgatgagttgagtttgcatcctcaaatttctcatgcaaaccactcctgctccaaagagtcccagatgcaactttgggtggttttgcaggcagtatggccatcatctcccaaggggagagagcacagggggagctggctcctccgctcacctctttgtgggatcccggcaggcctgcccaccgcatcccaggagagcagccatggagcccgattctgtttccaggccagctcgaagggtgctgggaagcactggcagagctcctgcagatgcagatgctcctctgcctctttcgtggcagtccagggaccagatgtgtgtctgcacaagccctcatcacttacacgtggttgaacaggcaggacttggtgaattccttctcagttttgtcctgagaggcagacagcgtgcccctggcagccttgaaatgaggggtcatttggggatcctgaaagctgaggttctagcccaggaagtgccccagagcccggccatcctgacacactgactctccttccatgctgggagacagcagctctgccctgcccacctgcccagaagtggccagctggctttttgccaggttctgccctctgcagccccagagctacacctgtcctttcttagaagctgccaatggccatgagtgtccaggacactctgggaaggactgtagtaaaatagtcaatgtgtttaatccatgtttcccactggcccacccatgcctttgacccacaggacagtggccacgcatgtgcttgggaaaaccaccataacaggtccagacaagagtgctggcctgagcatgggtcacgctaacgtgggtggctcaattaaggaacagggatggacttcctgtcctgtcgcccccacacactcctgcttcttctagtggccatttctgtgtgaggctggagcacagtggaaggtctgtgaacctgtattaagcaaaatagaaactaaatgtggacttggactgaaaggaaattgagttagacaatgaaaatggatgggaatggaatggaattcggatttgaactgaatggaattgaattggaagtggattaaaatggaattgaactataatctaaaccccagtagggcagaaaaaaatggacaggctgagccaggggagctgccctcaccccatctgttccctgccctggggaaccctctggtcaatactgctaataggaactgaaaattaaaatggtgctgatggattttctttaatatgcacagacgcatctcagagtatttctgtaaaagcagtgaccgagcctgtagaggtcatgaggcacctgggccaagccccgagatgctcccagaaacagcacttgagtcgtgcacttgaaattcaaagcgctgtccacctttgacagagcaagctcctcttgtccggccacgtacagtccctgagccacagaagaggcccccagaagcctcctccagcagacaggaatgaggagtcactgcccgtggggagggtgcgcggcggcctgcagcctgaggaacacacgtgacatggaacagcaaggattttccaccacggggttgctccgtctgtgcagggacccaagggtgccaagaacactgaagacttcaagggcctggcatcaaacactgctctggggggtaaacagacacctgctgagagcaaagggagggccccctagagagcaagaagactcagccctccagcgcctgctggaacgtggagctgcgaggccactcatcaagaaacggagcagcgtctggaagtgggaatggccctgagacgacagcagcaagaacacagagaattttgtcccgcaacctcaaagaactcagtcctggtcatggcacttgtcaccagtgagatctggtcttatttttacaggaaataaacacagtctatgagaattttagcaggtccatggcctttcacccagcatccctcggcctgcttctcttgtgtgagaacattctcttaatcagcaccacaccatcagcacgttcaggaggcttacaggaccctgttctgccatctctcacggtgtggtgttggtcaagaaagtgttcccggagcaaagcgtgctcagctgacacccggactggtggctttctctgcaacagggactgtcttcattctcctgcgtcttttgggctggatggttggtccagcatccactccacatttccctggtttcaagttctttcctgtgttgagagggagaatccaggaaggacccccaggccccatcccctggatgactccagtgaggttggcaacgggaggagccaggtgaaatttggaagatgagggggacccaggacctttccaccagctggtggcttctccaggttttccccccattcccccttcaccactacagatgggctcgagatttttggcagttttctgggtaacccctgaggatccctgccacagtgattcaggctgggcccatcccggctttctttccagcccttcccacctcacctcccttcactggaccctctgctctactgcttggagccctccatttcccagccccgcccaaacccatccatgcttgaattattttcctatttttttgttgttcttctttcttctttttgttttctttggaggcagaaacagaaagatgcctcttctccctaagcgcctttatctccatgctcctctgttctccctgtggttcctaggccacgccactgcataaggttgccactctgatgtttcccaaagcttgaggctccctttccctactgggcttccagctccccaggaagctcactccctacccatagctcccccgcacgtcctgggtggccctgatgtccccgctcaaacacccatggagatgaactgttccagctctagcgagagctccaggtccacaccttggctggagaggaccggagcctcctctcatcccccagccaagtaggcgcctttctcttcccaggcccgccaagccccctccagccagcgctgcattggccactcctgctgccagcaccaagctggcgaggctctgagcgccggccctgctgtcctgggtcctgggtccacccctgcagagcaagcccacccatccagtccccgccgcaccaccaggcacagccctccacagccctcagcagtacaatctgaaatcttcggcacttgttcttcctggctgtttgcctctctccccgcggggaggcgcctctgagtccccagggcctgactctcacagtgctcagtgattatttgttgaatgaataaatgtccttgacaccccatccagcagtctcccctgcttgcttctgagctggtttctctctttcacgactgtcctgactccgctggctcactttcccaccctattctgcgaccctatcatcttttgttttcttgtatttcttcttaggttttgtttttcttcatgatctgtgttctttgtcccaatgttttattatgggatagttccaacattagggacaaattacatagggtaatatgaacccaccacctggactggacaaatattagcattctgccatattcgctttaggtaatcatttttagaagtgaaacattatgcatagacccctggtatatcattcaccaatcccattttcctctcccctcgacagccttctcaatcatgtttgatatctttaccacaatctatcctgttgtttaataaagatatgttgtaatactttacacaaatggtatcccacggtgcatatcatgtgtgccctttgtttcttttttaactcaacattacattttcagattgatctgcgtctgtgcaggaccaactgttgcagatgcctctgtcttactaatttctgtgagttctttacacacgctggatgatgaacactggtctgtcatgtgtaagcagaccaactactggatagtactttgtacacatatgccatggatgtatagcctgtgttcactcgccagccctcattgttctgatgggtcactgtcataaggggggcagtggacacattcctggggagaccttcttgtgcaaacatgcaacaaggtctccagtctagagagagggacttgccaggtggaggaacatgcctggttccagcttcactaggagtagctaaatggctctccaaagggtggagccaacgaaccttccctttagcatgagcctagcgctcccttgcccactgccagctttgttactcttagatccttaatctctgttaatctgatgactataaagcaaaaggttactttaattttcattttcctggtaactggggagaggctgcatcttttcaggtcattgcgtgtctcgtttcctcttctgataattgcgagtttgtatcacttgcctggttttcactaagttcgttatacagtaaacatgcatatgtaaacgtatatatctttactaaaacaatgggatacattgtggtaaagatatcaaacatgattgataaggctgtcaaggagagaagataatgggattggtaactgacataccagggctccactctattcataaatgtttcacttctatttgtctttttgatttatgtgagctctttttatgagatggataaccatcatctctctgttttgtttatagcaaatatttcctcctgagtgtggctggtcttttggctttcagctttgtggcacctcttgttgtatagaagctattaatcataacatagtcagctttatcaaacttcagttttatgtggtttatgtttgtctgtcttgctggagaaacttttatgggccaggtgcagtggctcacgcctgtaattccagcactttgggatgctgaggcaggtggatcacttgaagtcaggagttcaagaccagcctggccaacatggcgaaacccatctctactaaaaatacaaaaattagcctgctgtggtggcgtgtgcctgtaatcccagctagtcaggatgctgaggcaggagaatcacttgaacctgggaagtgaaggttgcagtgagccactgcactcccgtctgggcaacagagtgagactccatctcaaaaaagaaaaaagaaagaaagaaagaaaaaggaacttttctgtactttgacatcataaagctatttcactatagtttattctaaatgttttaaagttttgcatttcatatgtaggactttaacccatctgaactttattcctggtgcagtgttagataataatatgaatattttacctctctgtcagtgacatttgaccaacgaacagttgttcctgttgatgtatggatccctgtggtgcgtaccgggtttccactctgtgcaggtctgcttttgcctttctgttctgttctgctgatctgtttattcttgaatagtctctatcaaaactctagaggaaatctcttggtatttggtagagaaaacatatctaccctctgcttcttcttcaaacctgtcttcaccatcctgggtcctttactattccatgcgaaggggtaatccatcttatcaggtgccatgagaaaacgctgctaggattttaatgaaattgcatttaatttattgattattttagaggagagctgaacatttgaaactgagtttttgtattcatgatgtagccttccaattagttaaatcttcatctatagccctcaaaaaaattgtattagtttctcatttaaaatgtcccacatctttattatacttatttctaaataccttagagttttattgctattgcgaatggtgtgttttttctattacagtctcctgttagtgttggctagtgcatagcagtgctgtggatttttatatcttcttatattaaacctcattagctctcattgtaaagtcttaaaaatttttgtatgcagaaagttatattgtctaccccaaaaatatgaaaatttatgtctcctcctttccaatcctcactcctctttttccatcttgtcttgcaacgttggctggatcatcagaccatgctgagtgatggctatgagagagtcaactccctgctttccactttaatgggactgcatctggagtttcatgggaagcttgagctttgatacaggctggctgtggctgcgttttatcaggctaaggtcatccttgtagctcttgttatctaagagcctctgctgggaaggagggtaaaataaacccaggctatatcctctgagatgatggtaagtttatctcctgagacttgttgatgaggctgacaataaaagtggattgcctagagatactttatgcttatgttcccaggacaaagcccgtcataactgattctgcagccggttccccatcctcacccctggtgtgaccagccagcctggccatgtgcccaccctctgctgaccactggctcttgttgatgactcccacccccacatatacacatagttcaatggacaaaaaattctaggaagagagtggagccgttatccaggtatcttttttttttttttttttgagacggagtctggctctgtcgcccaggctggagtgcagtggcgcaatctcggctcactgcaagctctgcctcccgggttcacgccattctcctgcctcagcctcccaagtagctgggactacaggcgcccgccaccacaccggctaattatttgtatttttagtagagacaggatttcaccatgttagccaggatggtctcaatctcctgacctcatgatccgcctgactcggcctcccaaagtgctgggattaaaggtgtgagccaccgtgcccggctgccattatccaggtatctattaccaaagagcctcccacaggggggtagttccatcaaaagtagtaaccaacccagggaataagtgtatgtatttctctccagagcaaaaaggttgatgtatacacatctgttccaccaaataggcaatctggtgactgttgggctaaccgtccagggatctgagggcctctctgggttctccaagtgcactcctcccccaatgccaggattcagggactgcctcctgagtggctctcatccactctgtctctaggacgatgcacccacagcaccatcggcccagcacagcaccccctgcgttccttgctgccctccaattgctcgggtgtcccagatgatgggtgcagcctagcagtggggtgggcagggccgtgactgggcttctcgcatctcttgtgttaaatttctttcttctgctcaatgcttcccaccctgaaagaaaaaggtatgctccagggcagaggatgcgaggtgaattctcacattgaagttaggggtaccattgacgggcagcggtcagacacagccgcgggtcagcagcgcttaaaaagggtttgagagtcgtgaggctcaggatggcatctgaggccacaggagcatatctcactcactcacacgcctgccacggggctgagggtgagctgatgaaggaggaaaggaaggaggagctgacaaataaattgcttttaaaatgacttacaatgttgtgattcagtggttattccctgagcctcccctcacctgctcctgacaccgggactcgccgcagaggtgtctggaccatggtccggggggcggctctgagcgtcccctccgagcatccctcggtgtctcctttagccattctccttactctgctccactggtccctgaccagtcactgctgtgagagagaaaagctatccctttatgtcacttcgttgcagactttgtgactcgcaaaatattaactgactgatgtttagagacacttcatccttggcagaatcggaggcacaacttcccttgaaaagctccagaggtttttgggaggccgaggtgggcgaatcacaaggtcaggagatcaagaccatcctggctaacacagtgaaaccctgtctctactaaaaataaaaaataaaaaataaattagccaggcgtggtggtgggcgcctgtagtcccagctacttgggaggctgaggcaggagaatggcgtgaacccgggagacagagcttgcagtgagccaagattgcaccactgcactccagcctgggcgacagagcgagactctgtctcaaaaaaaaaaaaaaaaaagaaaagaaaaaagaaaagaaaagctccagaggtaggtggctttggccacctggtcctcctaggggcatctggtctctttctttcaagtcaagggcagagacttggggcatttgaagagaggtctgatgtgactttccactttaaatcgtggaagagggatgctggaagcatggctttatccctcccttctcaaatcaacctacctacctcttctgaaatggatgctggctactgggtgggctgagtcctccctgctccagacaggtggcagtagaaagaggttgagagtggcagcaactcggaagacttacaaggcttactcctaaatatgtagattgcctagtgataatgtagattgcctagtgacaaaagtatcattaggcaatctacattagacatacatatgcatatgtatatatactactttatatataacatatatatacatatatgcacatattatatatatcagtaaggattcgtgaacatttatttttatttatttattgtgagacagagtctcactctgtcgccagactggagtgcagtggtgcaatctcagctcactgcaacctccgcctcccaggttcaagtgattcccctgcctcagctttccaagtagctgggactactcccatctggtgtattagtagtagctggtggcatgcaccaccacgcctggctaatttgtttttgtattttggtaaagatgaggtttcaccatgttggccaggatggtctcgatctcctattttgcattgcatgtgctttattttgttgctcagattattccagctttggctactgggaactctttcagtggttcctgtgtccctccggcataatctcattcttgtggggtttttaaacgcttctttacttcctggcactacacgatgctctagccttcttttgtataatccttaccccagccctagaatcagccatttatctaaggatttctgattccttttattggagaaaggcattagaaaccaagatgtgggcactgggtgtgcttattgtgactggagtgtcaatggaaattctggagattaaaagtatagtgattaaagtagaaaatttactagagaggtttgacggtagatttgaattggcagaagaggtaatgaactaatttaatgataaataaatacagagtattcaatttgaagaacagatagatagaaaaaaaactaacagagcttcagtgaaatgtggaacaccactaagcaccccaacctacatgtattgggagtgccagaagggaggagaaatagaaggagacaggaaaagtacttgaagaaataatggctaaaaactttccaaatctgatgaaaaatactagcctcacatccaggaagctcaatactgcaagtgggataaaaacaaagagaaacacccaaacacatcataatcaaaacattaaagacaaacacaaacagaaaattttgaaagcagttgatgacagaaaaatccaaattttgccaaaatatatttaaagaggtttattctgggctaatatgtgtgactatggcccaggttacacaatctcaagaggtcctgagaaagtgtacctgaggtggtggggttataatttggttttgtgttgggaacaacacccacactgaaggttgtgggtttaccggaatgagggcaaggaacacctgtcccacccaggggggaaaaccacttaaggcattagtgatctgtgccttaagggcatgttcctgctgcagataactagccagagcccatccctttgtttcctgttttagttaatctataatctatagaaacaatgcttatcactggcttgctgtcaataaatatgtgggtaaaactctgttcatggctctcagctcagaaggctgtcagccccctgatttcccacttcacactttatatttctgtgtgtgtgtctttaattcttctagtactgctgggttaggttctccatgactgagctggccttggcagttttacagatttcagggagacaggaattgcaggtaaaataataaattgatatgagaagggtgcacattggtttggccagaacaggtgggacttctcaaagcgggggcttacaagtcataggtgggtttaggggattcttcagttgccagttggttgagacagttaagctattgtctaaggacttgaaatcagtagaaaggaaggcctgagttaagattaggaagttttggaggctgaggttattgtgtagatgaagcctcatgggtggcagctctcagagctataatagttggtgaatgactcttttcagactttaaaggtgtcaggctctcagttaatctctcctagagctgagaaagcctggaagggaaaatacctggttacattcatggagactttctatagctgcaaattttccccataaaaggtggctttgcagggtcattttaatctgttggcactatggcagccatttcaaggtatgtttaaaaaatatattttgtggtaaaatacttttattaatatttcctttagagtctgctacttgtcatgtgatattataccaaagtcaagtggaaagcaagccacatttaataaaaacctgtctgatgagatttttatggtttgtagagcatgactccccagtccccttagataggaatttgggcaagagaaaaaaacaaaaaaacaattcatgcaaagggacaccaataagattaacaactaacttcatcagaaataatagaagccagatggcaatggaatgaagtagtgttgaaagacaaaacactgtcaaccaaaaatcttatttccagcaaaaccatcttgaaatataaaggtgaaataaagacattccaagataaaaactgagataatttattgccagcaaatctgacttacaagaagtactaaaggaagttcttcagactgaaagcaagcaacacaagacagtaattcaaatccacacaaataaacaaaagtgtcagtaaaagtacttatataggtaattacaaaagactgcataattgcacactttccctttgttttcttgccttacttaaaaagtaattacataaaacaatatatgtaatatacaggtgtattgttgggcctcaaaatgacatcacaaaatggggagagaatggagaaatataagggtaaatatagctttacccttatattcctcaagagtaaactaaaaccaaagcaaacaaaaggaaggaaataaaaaagattagagtagaaataaaggaaataaagaatataaaagaataaagtcaacaaaatctacggttttgttcttttgaacacaggtttggttctttgaaaagatgaataaaagtgacaaatctttagctatactgtccatgaaaaagagagaagactcaaaccactaaaagctataagattactgaccttacagaaataaaaaggagaataagagaatgctataaacaactgtctgccaccaaattatataatttatatgaaatagacaaattcctggaaaaagaaaactaccacaactggttcaagataaaaatagaaaaccttaatagacttataacaagtaaagagatttaattagaattaaaaaccaaattgaaacaaaagaaaacttcccattaagaagagcccaggtcctagattaaccgccaaattctacgaaatggtcatagaattaatatcaatctataaattcagtattaacctgatataaaaacctgacaaagatatcataaggaaaaaaaatagctctggtgaattatcttctgaatagagatgggaaaattctttaaaaaaatactagtaaactaaatccagcaacatataaaaaggattatgtaccatgaccaagtaggatttatcccaggagcacaaggttaacttatcattaaaaatcaattaatgtaacacaccatattaatagaataagggacaaaagtcatattatcatctcaatgcagaaaaagtatttaacaagcaacatttttgtgataaaaaaattcaacaaactagaaataaaagggaacttccccaatctgataaaaagcatgtacatggccagatgtggtggctcacacctgtaatcccagcactttgggaggctgaggcaggcagatcacgaggtcaggagttcaagaccagcctgatcatcatggtgaaaccctgtctctgtgaaaaatacaaaaattaaccaggcatggaagcacccgcctgtaatcccagctactcaagaggctgaggcaggagaactgcttgaagctgggacgtggaggttgcagtaagccgagatcatgccactgcactgcagcctgggcaacagagtgagactccatctcgggggaaaaaaaaatgtacaaaaaacgtacagcaaacttcaaactcaatggtggaagattgaaaacattgccctctataatcaggaataagacaaggatgtctcctgttgccatttctattcgacattgtattggagtttctagccaggacaattaggaaaggaaatgaaataaaagcattcagattagaaaagatgatgtaaaactatctctgtttgcaaataatattattttgtatgtaaaaacacctcaaagaatccacaaaataaaaattattagaggtaataaattgcttaaaccaatttgaaggatataagattaatatattaagacaaaaatcagtgtatttctgtacactagaaatgaaaactctgaaaataaaattaggagaaaaatacgtttataattgcattcaaaatataaaatacttaagtataaacaaaataagtgtaaaccttgtacactgaaaactataaacattgttgaaagaaactgaaaacaatcaaaattaatggagacatactatcttcatgggtcagaagatttaatattgttaaaatgacagtactgcccaaatcaacctgcagagtcatctcaatccctatcaaaatcccaactgactgttttatagaaattgacaaactgactctaaaattcatatgaaaacacaagagactcggaatagcaaggaaaacaaattgaaaagaaaggataaagttgaaagactcacacttcctgatttcaaaacttactacaaagtgacagtaattgagacaatgtgatactgtcatgaagacagacatacaaatcaatagaatagaattcagagtccagaaattaacctattcattcatcgtcaattggttttcaacaagctgctgagacagttaagtgggggaaagaagtgtcttttcaataaatggctttgaacagctgtatttccatatgcaaaataatgaataacttctaactgataccatacacaaaaattaaaactcaaaatggattatagacctcaccgtctatgagattaaagagttaaaactacaaaactcttagaagaaaacataaaagtcaatcttcatgaccttgggttaggcaatggtttcttaaataggacaccaagagcacaaaaacatcatccaaaaacagataaactgggccaatcaaaatttaaacttttatgctgcaaataataccaccaagaaagcaaaagtccaccaccatagaattggagaaaatattttcaaatcatatatctggtagaagtcttatatccactatatatttacaaattcttatagctcaataacaaaaagacaaaaaatactatttaaagggggacaaaggacttaaatagacatttcttcaaagtaaatatacaaaaggccaataagcacatgaaaagctgcgcaatatctttccttatcaggaaagtacaaagcaaaaccacaaccagattctactccacatcctgaggacgcctaggatcaagaagacagataatgacagctgcagatgaggatgtgaaggaactggaagcctgttttgctgatggggttgcaacatgctgcagctgctttggaaacaggttggcaatttcttataatgttaaacatagatttacaatatgacctggtaattccactcttaagtgtatatacccaaaataaatgaaaacacatgtccacaattttacatgcaaattttcatagcagcactattcataatagacaaaaattgaaataactcaaatattcatcaactgataaataaataaaatgcattatatcagtacaaagaaatattatttggcaatgaaaaggaaataaaatactgatacattccacaaaatgttgacagggatgaaccttgaaaacacgctaagtgcaagaagttggtaacaaagagacacatattataggattgcatttgtaatgaagtgtttaaaacaggccaatccatagagagagaaaatggattagaatttgcttagagctgggaagtgggcagagaggaatatgagtgactgttaatggataaaggttttcttttatgagaaacaaaaatgttctaaagttagattatgatgatggttgcacaaccctgtgaatatactgaaacacatcaatttgtactctttaggtgacccacatggtatgcaaattgtatctccatgatactgtttctttttaaaaaaaaacatcaccaggtttaaacaggtcaaggctggctttctctatataatagtacaaataatttcagtgttcttttgaatattctgggacatgggaaaagatgggaaattttaattgtataagtgaaactttaattgtataattaaaaaagaacagaaaaagataaccataaactgactcacaatatacatgcaaaaagaatctgaataaaatattagcaaatagaatccagaaatatatttctaaaaatccgctatgaccaagtattatgaattgtttttcaggaatgcaaggtagttcaataccaagaaactagctacaaaatttagtatatccatcgaccatatgatcccatcaatagacacagaaaaagcatttgggaaaactcagcaatcggtcctgcaaaaaaagtcttgagaaaagtaatactaaaaagaaactaccacaaaagagatctcaaaacccggcagcaatttgcaggggaatggctctcccatggtgcctctaccacgttgcacctctccttacaggcctcctagaggaggcttggccacagtctaagctgagtcctgggcatgattcctcctgaagcaaggggagattagcctggggaggagtcagtgagggcagcccccaatccgcatgagaatgcctccaagggttgctcatccatctccccagtttccattgagcacaaagctcttcctcaccactcccctgtcctgtggagctgccggcttccgtgtagtctgtgcaaatgcttggctgtagttcagagaggactcctcaatggcagagtgacccaccactcaagccggccatcacctgacctttctgtttcagtcgacctgtggagtaggggcccagggacctgacaccgcactgctcatggctttgctgtctgtgtgagtcataaactgtcttgattcctcttgggcgcactgtcttcttggcagccaggtctatgggaatgaagcctgctgacctcacagctgcagccatgctccctttagggatgacttggccatctgacacagatgatatccaaatcatgaaacaccaaactaatacaattaaaaccagaacttagcctgcgaggcccactattcttatttgatattgcactgagggttcaagcagatgcaaatggccaagaaaataaaacatatagtttaagcattggaaaagatatagctattagtttttacaacccagatattgtatgaaaaattagaattaaaaagaaaatgtgataggatgagacaatgtcatataattatgcagaaaccaatgcattatctcttttcaaatgataggcatctagaaacggaaaggggaagaatcagtctgttcacaacagtgacaaaaccgtgagctacttagggatcagaggaacaggacccaggaactgtgtgcctggcatctgctcacagccactcagagccattttctgtcccgccctgctccatactctagtctcccttcccctctgtcttccagcagatttggtcaatgggtggtgctgacccaagattgaagagtgggatgaaaggatacatgaggccctcctctccctctctctgttccagtggcacctccagctgcagctgggtctcctcggtggttgtgggctcccacctgaaagcccctttctccatggtcccagatggggctgaagtcttaatatgattagagcatgctccacactgaccctccaggcccagccctggggtagaagtatcctcaccaccatacagattaacccctacaaccagttccttgcattaaattccctgtgcttgaaagatttggagagatttctggtttccaggtcaaagcctgattgatacaatccctatggaaaaaaatgataaaatcttatttaaagacacaaaacagacacatttttctggataagaactttcaatttaaaaatgtcaattttcctgaaatttatctttaagttgaatgccatttcattagattcccaacagagttttaggggttttggtgtggtcttggtgggtagaattaacgttgacatttttatgggaggataaatactcatgcaagatgagacaaccctgccactgtacacacattgacaacacaccacgggatgggacagaaaaccagaaaatggcctcaggataagcaagaaggtagaccaagcttcatttgtttcagggtaaaaggaagcaccatttaattaatgggactagcacacccagcggcaagctagaagaaaataaaagtggatccactccttcatcttaatcagaaataaattctaagtggatgaaagacttaaatgtaaaagaaagtaaaacaaaataaaaatactgcaagaaaatctagaagaccatgccatctagggtaaggattcctcattaagcaagactgaaaactcagaaattcttagaagaaagtataaatatgctggactataaaacaatttaaaactcatctatgcagagatacctacaacagacaaaatataagtttagaaaaacaaaaactgggccaggtgtggtggctcacgcctgtaatcccagcactttgggaggccaaggtgagaggattacctgagatcaggagtttgaaaccagcctggccagcatggtgaaacccggtctctactaaaaatacaaaatgagctaagcgtggtggtgcatgcctgtaattccagctacttggaaggctgaggcaggagaattgcttgaacccaggaggcagaggttttggtgatccaagatcgcgccattgcactccagcctgggcaacaagagtgaaaaactctgtctcaaagttttttgggaaaaagccaaaacaaaacaaacaaaagaaacacaagaagtgatttatgattaaaacaacgttcaaaaagctgttatctgtaagatatgaaaagtgcttatgaattgataggagaaaaaaatccaatcgagaaagggtcaaaaaaatacacatacacaagagtaaatccaaacggctaacatcatataagaaatgttcaaaattaccaataattggtgaaatacaagttaaagtcacaaggggctgtcacttaaaacccacctgactggcaaattaaaagaaaagggcagcgcgacggatttggggagagaatttgaagaagagagagcgtgcatcactactgctgggaaacagacattctgcggcatttttggaaggttatctaggaatgtcagttcaaagaaacaccatctatgctttttaacctccaaatcccattttgtagtatctgcttgggcagccacagcacagcagcgcagatggcgccttacacggcaggaagagattctctcatgctcctggcagctgaaggtctgaggtcaaggcgtccgcagggctgctttctcctgaggcctccctcctgggcatgtgacgtggtcttttccctgggtcctcacatggttgttcatctgtgtgtgtgtgtgtgtgtgtgtgtgtatgtgtgcacgcgcgtgtgtgcacacacttgtgtgctaatcacctgttcttttagggacactagtcatcagggcccaccctaatgagctcattttaatttattacttctttagagaccccatctccaaactcaagcacactctgcataccagggtgggggctttactgtaggaaactggaggggacccagctcgaccccttgcagagtccttgtgcttgtttctgtagaaatgaaagcactggtctgctaagatgtaagaacaaggatgtttctacccacagcgttgtttgtagaatcaggaagaataaccctaaaactgaaaacaaggggatccccagagatgcagttcctccatgaatcaggagggccagctcagccatggaatatgagaccatggtgctaaggtggctggcggggtttcccaaaaggtgaggccgttgagcacagaggggaagaccacggcgtctggtccccgcaggccccacgaggcccagtgatggtgatgaaggcaggaacatgagcagttgcctggcagggagaccacgtgccggcagacagtggctgtggcctccgtggggacgccagtcaaggggaccatgcgggaggggaagggcagagggaggaaagccactgatggaaggaagaggaagaccacagtgggagtgacctgcccggagatggccccctcatgagtgtccgggccctcgggctgaggcagcaggcaccctctgacccaggcctggcggggaaggagagcctgggcctggacctgtgaaggagaccgctggagggccccagcgaaggggacccttcggggacctgactttgcaggcagggaagggctgggcacccaggagagaggcctctgctccctgctcctgtccctctgtctatggccatgttgttaacaagcagagaggcacagtttggctctccggggacggcagaggccttcttaacactggctcagcacacagctcctcctgagtgtccctgatggtggcggctctgcgaagcttagccaccagggcagtctcctcctctagggccagcagggtccctgctggaagcgctctgcccgctcaagggaggcccacccagaaaaatctccctttggagtaactcaaagtcaactgctccgtaccctgtcccctccaggggagaggactgcacagggcatgccagagggggcctcaggggtccccttagaatcctgggaggaggagaggtgagggtgaagggaagaggaaaagggataaggacggccccaaggaaggaaagggcattcaagcactgctcacccaaccctcccctcagtcctggcaatgggtgtcccagctgaggggacaggtaggttgctggaagaacacccccaacatgcaatgctgtgctcgggatgccctccagacccctgcccctcccaggaaggccccgtagcccacctcccctccaagtccctgtcccagcagtggggaacccgggctttgtccgcagatgggcccagggcctctacccagcacgtgacgctagagccccaggtgaggttctgccatggacagggtctctgaccagcaccttgttcactgctcatgtggtgccctgcaggcttggcatcccttgcccccaccagccccttttcacagccctgttttcccgggaatgtccactgttcacggaagtccttgcagctagaggtcatccaggctgtttgtcctcatctgtcacattggagtggccggctccaatagcatctcaatctgcccaccacagcacacatgacatcctacgccaaaggtgacatcctaggcctgggggtccccgggcaatgagaactggatccgagcccgaatcagcctcctcctgcatgaaaggagtgaggtgaggggcgtgtgaaggaatccgaaacaggacagcttcatctcgcggctccgtggcagagggaagtgtgggcgctcggagacgggcctctcgctttgtctgggtgaggggaggaggcctccttgtggttcttggtctcacttcctccctcccactggcaaagccttcctccctgggttggaggtcagtgttcgggccgggcacagggttcattatgaaccaaatatttgagtcccccagaatttctgtgttgaaatcttcacccccattgtaatggtcttaggaggtgggggctttgggaggtgatgaggtaatgaggggggagctgcaggaacaagactcgtgcccttgtgaaggggcctagtgagacacttgctgctccccatgtgacgatacagtgaggagacgccatggagaagccaggaggcgactctcccagacaccagatgcgccatgccacgatcttgggcttgcagcctccagggctgtgaagaataaatatctgtcgctcacaacccccaagtgtgtgacacatagtcacagcagcctggaggggctaagagagggctcatagcgagggctcaagctctgggctctggaggcacatgctgtgtgaccttgggcaggtacgtgacctctctgttccctggttttctaaggtgtaaagtggtggtgggaatcactacctaacagggttgttgtgaagacaggtgtgggaggcctgcggcacctgcgcagggaaaaggctgtgggtgtcagtccaagcaacagtcagggctgggtggccacccctggctgcgggatccacagggctggaagtctgcctctggtgattgtgtgaccctgggcgggtctccctggccctggctgcaagagggccccagagtggccctccacggtttcctggtaagggcacaggaaggggcttcccagccgtggatgacgtcagaagaggctgtgggagcagcaggggcagagaggatgccaagagcagcccccaccctccatggggccttccccaggcctccccaacccggggatcggggatacgccctctccacccacctctccagggacctgggaataggaaagctgtttgctcaaacacgcctgggcccccagacacagaacccagtcagtgttcctgggggcagtgccaagggtggctgggggcgagctgaggcccagccttcctccctgatgtcaggcgtgtctggaagccgtttcagcattcatcagcccttcgacttctccctcggtggccctgcaggtaactatctctaggttgatttgtgttctctgccccttaggagagcctggggtctgcggtgactctcaaatgacgctgtcagagatgtcaacccctctcccagtgataagagtcgcacacctggtcagtggccaccctggagttgggtccaaccctgccttttctgcaaagtgtggacaaaactcagaaagcctggagagagagggagccagggacagaagaggggaggagagaggaactggggttgggggatccgaaggagaacagggctcctggctccgtggcttcccgctagctcaagatggtccccttggtcccacattgaagtctcacaaaactcctaggagctacacaccagcatcaaaaagacaaacaacccaaccaggagctgggcacaggagtttaaaagacatttctctgaagaagacctgcaaatggccagcaagcacatgaaaagactcaacgccattagtcattagagaatccaccaaaaccacagcgagatgccacttctcactccccaggatggtgaggaggagtagaaggggaaggaggggaaggagggaatgaaggagagagggagggagagaagaaaggaaagaaagagggaaggaagaagggaaggaaggagggagggaaggaaggaaggaaggagggaaaaaaggagggtgggaagggaaagagggcaagagggagagaaagaagggagagaggaagggagggagggtgggaaggaaggagggagggagagaaggaaggtaggagggaggcaaggagggttaaaaggaaggagggagggagggaaggaaggaaggaaggaaagaaggaaggaaggagggaaggaaggaaggaaagaaggaaggagagaaggaaggaaggaaggagggaaggaagaaaagagagaaggaaggaaggagggaaggaaggaaggaaggagggagggaagaaggaatgaaggagggagggagggaaggaagggtcacaggagggactccaaggccctgggctcccattaggggctgctgggcaggcaggttgtgctggaaatgcaggtggaaacaggcatggggaccctggaggcaggagatggtcacagcaccagctgctctctgttgaaaatagcgagtgttggcgaggacatggaggaattggagcctcgcctgctgctgacgggaatgtagaaggatgcagccactgggtggaacccagcaggagcctgggaggccttcgatgtgacttggtaaccagcggagtgaggcaccaaccacatgctaacaggggctgagcacaccatgctgggcgaggcagccagtcacaaaggccacacagcaaatggccccttctatacgaagtgcctagaacaggcaaagctgttgaagacagaaagtagctttgtggttgccaggggctggggttggggcagatgggaagtggccacgatggatatggaggtttcttttgggggtggtggaaaggttctaacatcagatgatggtaatggtttgattgtgcagctttgtagatatactaaaaaccattgaattctgcacgggcaaaaagcctgggaggtatgaggcagaatcaacatcttacagaagaggaaactgaggctcgggcattttaaataaaagtcgtcttactgctgtgcccgatgccttgaaaagccggctaagacttctcatgggaactgtctccgcaacaggccccagctggcccctctccagcccttccccagggaaccttccctgccagagcccgccctgactccctgctcacaggcagcgcctcaccaggagcaggtctggggacagtagtgggtggctgcatatccagctgccatggctccttcagccttctcctgagaagggaagggaggtggcactgcaggggagaggagggtgcagaggagatgccactggcagcaggaggatggatgcagcccagctgctctctcaggagtgcagaggggctgagtccccacaccaacggcccagaagcatggggtctcactagcataggactggtgttacatgggagagactccgaggcccccggctcccatcaggggctcccgggcaggcagcttgtgctggaagatgcaggtagggacaggcatggggaccctggaacaaggcaggtcccgcctgtctgcatgagccccaggacagccatggcccctgcctatgaacctcctctctgctcttggttaaaaagccccatgtcatggaggcagcagccttttcaggcactggggcccctccagacagaaaggggcccctccagacagaaagaaacccctatggcatggagccagaatcaccatagacaccctctttcagagttttcaattttatgttcacttacttttaggcaaatgggaaaaggttggaggtacccagcctgcccagcctgcgtggttttgcggtggtcccacactgaatcatctgtcagagggctgtctgtggtccctcggggctggggtctgacacccccttgtcaggactgcaggcctggcactgctgtgtggctcagggctgccgccttcctgcactggtgaagggctgaccgcgcctgacgccgttaattgagcttcctccgagtgggacaagtgagcgatctcatttctaggatgatcaaattttgccagagcttgagcaaagctactcaatcatgggattggaaggtgggagccccacgtgggtggaacttcattcctgcagagaagattcctccagagaggccccaggcacagctacggaaataaaagcggccacaccccattcctcttgagatgacacggactccccagatgccccgctgtcagcccagcgctcagcttcacggttgtctctcccccggctcacccggtgagcctctgccctggagctgacagggccacagccaaggcccatcccttcatcctggctggggcggaacctctctgccgccatgggcagcacttctcagagggccaggggctgctgtgtggactaccgtcctcgcacaaggcagcaagtgctccatgtccgtggcgctgggggatggagagggtcgccaaggacctgcctgcctgcctgccttgggatgttctgggttctcaactagatgctgcctggacctgtggagtggccccaggaccccatccacgctgcctgggccctgccagctggggcctccagtctgccggtgcgacctcactggcccctggggctggggtcccctgggtctgctatgggaggcaagggggcaccgtgagatgccacttctcacttctcaggatggcagaaactcagccctgagagaggctatgtccagacaccacatttagggcactggcgcgtgacaggtgtggcagtgggtggggtgtgctcagtgacctggaccgagagcaggcccgaggcccagcagggactcagagaaacatgaagtgccaggcaggaggcccaggggccaggaggggccacggtgctcccaggcctcgcatctacccatttcagccttctaagatctgcagccagaggtccaagaacaggcagaggaggcccgtatgggggtgctgcagcagagggagtggggttaccagccagcggccaaggctcacaggagcaggacctcccaggccacgcaagggagaggacatttccagtaacggcgtttcagaattcctcctccctcggggtccagggccttcctctgctccgaggaattctcaggccagtccctgagacaagacaggctggagggaggcatgctgagcaggcagggcccggtgtgggaccctccgcgggaatcgtccgagcagcatctggagaaggcggagggtgggaagctcagtggagtgtaccctctagtccgcctctcttgctcccctcctgccccgcgaggctccctgcaggactccccgacctgcctgcctctcacccataaggtaggtctacagcaggtcagtctgctgggggcccaggtgtgggacttgagttctcctggggccaccaatggcttgaagggtggcctcaggcggggttggcgacccctccctagtctgagtttttgcttctaggagactagaagtccctggagtcccccaggtgttaaagtctgggaggagagactctgcctagcgcctcgtgtgggatgtcctgaagtccaggccagcccaggagccttcctgggggtttggaatcactgctggaggatactcacccctgcagggagctgtccaatggagctggggcctctctgaggcagtggcctgacaggctgggccacccagggccgccacccgggagccccaggaccttaggcatgtccagctcaccttgcggaaacatctcttgactgccgcagtgggtgtggctgcagaattcccatccgtctccacgctcctttgagagcgcacagcagaactgctgcccgcgcagcctcgtgggtccctcctgaccctagatgaggcgggctcctcctccctgggcaccaggtgctcctgggacccgggcttagcacgcttctgcatgagacgggtttcgtgatcactccatactgtaattagatattaaaaatctcactgtgccttcataaaataacgttgaatgaataatagagtatcacagttggaaagtcatcaaaatgtaataaaatggtgttattacaaaggcttaaattttaatgatgttttttagtatgtcacttattgtataattacaaaataagatagagtaattaaacggagacttggggctttgcagggggctggggctgggaggctcctgattctatccagagtgggcactggagagggagcagccagcctcctggcggcagggcctgggttgggggtgtggccaggcatgggctgaccttctgccgtcctggaggtgaggggctcgggaggacaaggccttgggacttgtagagccccccctgtatctcagcacacagggccgacctcaggctgccaacgcccacagctctttgccaaatgccctgggacctcctgctgtctctgtcacagggcagaagtgccatgaagttagccttctcgggagctggcctggaacagggagcctgggatatgtggctggatgtcccagctcccgggctctcgggcggatcatgctgctgctccccctcccacagggagcccttcgtggctgcgctccctccttgactcacttgtctcaagcaagcccctcacctgacccatggttcccagggacccatgggtgctcagtggacacctggggagttggctatgtgccagctgtgctggatgcagggctcacaggggaccagtgttcaggcagcctatgggcagggtgtgctgagtaaaggaagtgatgacctatgggttgcctccacccagcccaggaagaatgacctggcagggggaacagtaacagagctcggaggagcaagctcaggaaggacaagtcattctaggagggcagaggcaggggttcctgaattaaatgacagctaggtcacttcacactgaggaaagctatcctgtgcacagattgaaactgagacctcctaattaactaagggtgggccctggtctcaggttgagccagcctgagcctgaatcctgatgtcagacagcacctgagtcctgttcccagactgaatctaagtcctggtatcattcagactgagtccaaatcctgatctcagactgagcctgaatccttatttcagaataagccctaaaaattctgactcaggttgagctctgaccctggtctcacagagcctgaatactgatctcaaactaagcccaaatcttgatctcagactaagcctgaatcctgacttcagactaagcctgtattagttcattttcacactgctatgaagaacttcccagagactgggtaatttataaaggaaagaggtttaattgactcgcagttccacatggctggggatggggagaactcaggaaacttacaatcatggaggagggtgaaggggaagcaagtaccttctttgcaaggtggcaggagagaagggtgaaggaggaacttccaaacacttacgaaagcatcagatctcatgagaactcactcagtatcacaagaacagcatgggggaactgacccatgattcaatcacctccctccctcaacacgtggggattacaattcaagatgagatttgggtggggacccagagccaaaccatatcaaaacccaaatcctgatctcagagtgagcctgatactgatttcagactgagccctgaatcctgatctcaaactaagcctgaatcttgatctcaggctgagccataaatccttgtctcagactgaactctgattgcagctacatttccagacctttctgacccccaattttattgccatctgaggtcacctgggagcttcactctgggctggtggatgccctaatgttctagaacaggagctctggagtacctgttcactttctagtccccttttctcatgtcctctcccagttgtcctcttgcagcctgaagaagtctcatggttctagattgcagacttctgctggggcagcttgcttacctagcagaaaaggccagggcccaggtgaccggggaaggagttccctgcagtgaaactccccctggggactgatcattcaccatcgcctgcccacctggggaggaacggctccctcccacttccttcttgggcggccccacccttgcatcctctggttgccataaaactcttttgcacaggaggctcatgcctacccctgtgtcacctttgggatcagcctccaggcctgcccagtgctgtaactctgctcaggacagcaagatgatttcagaagaagaggtcgggcactctcagcctccctgaggctagtcagagcagccctggctcacgcagctgctgccatggacttggatcccaggctgctctccacctctctccttcctgggaagcaccgccggtccttgttcctccaaatgaccaggacaggagctcagaggggaggtcatccccacagatgggctcccaggacagcacctgcaaaggtaccctctgtggtcccaagagccagtgcctggcatggccgcccgctttaggctgtggctgtgggcaagtgtgtgctctccaggaagaaggggcctgttgcctcactgtagatcatccttaaaaaagaaactagagacacgccgagtgcctctctgtggccccataaatctggagaggagggagctgaacagagagagcttaggcttttgaattttaaatggccaatttggtcaatgaatcagtttcactgggctgagactgcgtggagacgaaagtggttttaagacctattgaaagcagtgagagcctctttgtccacattttctcagactgccaccctctaatatttcatctatattcatttttatggcttcctaaattacagatgtcagttaaaaaactgaaaaatagagggtggggaggggggaaattcatcactgttgaaaagaaaggtgaagttatccctcccaaagccagtgtgctgggacgtgacccagaactcacagctggtccttccttatctgggctcattcttcacctggtccatgacccaaggctgggcctttgctgcccatgggacaaagaatgaggcagacagatgtccctccagtggggagctcatgttctagtgggaggagagagacctcctaaaagtgagcaagacaaagaccctagtactcggggcaacacagagtgggtgaggcagggccatggaggagggagatgagagtagggtaggaatgacagatggcagtagcacgctcacgaggttggtactccacaagtctccgggctcagaggtgtggagtatgtcaagctcctgcctccagggtgaatacaagatgctgcacttcacaccatctttgtgagcgtgctactgccatctgtccacagagtcatggttttttgggttccgtggaccacattgaggggcaattgtgcagatgtttgctgccatttagaagatcgtctgcctcttccagctactttcaagatttttccctgtcttctggtttctacattttaagagggttttgttggttcactcttgctcttacttgggtctgtagagcccctgggggctgcagcctggccactgcggtagccacagacagccgctgtctgtcactcccaggtctgcccatccacctcgggtcagtgtgggcagtgggagccacctaaggaggctgtgcacggagagtcagaagtgaaagcgtctcagggaaggtttcctgagctgggtcagcaccacaccgcgccaggctgctggggccacacaaaactgagcatctgctcagcctcagaggtggacaggggccttctgcttcatctccttggggcagttcaggcctctccccatcagctccacagggccccaggccacaggccagactttctcatcctctccctggctgtggatgcaggtctcctcagggcaccttcccagcagccatcccagtcctggagatcaggcttggggcctggtttcctgacctcccatggccattttccctgtggcctctaggctcctccttctcttaggacaggagacttgctgccacaagtattgctcagtgataacatcctgccaaggcctctggggtaaagtcacaggcctgcagtgggctggtctcccctcacaggcctgtgatcccccagggactcaagcaggaacccctcctgcttcccccagcttctgggggctccagcgttccttggcttgtggctgccttcctccaactgttcttctgtctccatgcgagcttcttctgcctctgtgtgtctccaccatgttctcttacaaggacattttccactggattcgaggcctgccaggtcagctaggatggtttcatcccaagcacgggaagccaaaaggaccagtccccctcagagccctgaggcccagtgtggggatggcagcagcctccactagaggctggggtctgtggctgtgggcggtgtagggacccccggccctcagtgctgccgccttccaaccagtctcctcccacacagacccgcatcatctggctcccccagcacgggccttccccgcacacccagccaggctgggacctggggctcttcctccaggataacagcaacatctggattgtggccatgtagctgggacagacacaaaggtcactggagaggctgccactggccaagagaccaagagccctctgaagtccagcactcatctccataatgagctctgaaccaggctcgctcagccggctgccctgagtcgggaggcatcctggcctccgtcccacccagactcacacggattccatggccacctttctcaccaacaccaggaattcctttgtaccctggctcctccactgtacctgtccgacaaaccccaacataaatccccagctgtattaagccattcttccattgctatgaagaaatacctgagactgggcaatttataaagaaaaatagtataattggctcagggttctgcaggaagcatggcatccacatctgctcggctcctggggaggcctcagaagctttcagtcacagtagaaggcaaagggagaacaggcacaccacaggaagaaagcaggagcaggcaggggctggcagtgtgccatgtcaatttactgttgccatggcaatgcccaggcgttacccctctttccatggcacccagtgatccaaaagttactaccccttccctgcataccccttaatctgaatgcaattaaaaatgggaaccagggtgtggtggctcacacctgtaatcccagcactttgggaggccgaggcgactggatcacctgagatcaggggttcaagaccagcctggctaacacagcaaaaccctatctctattaaaaatacaaaaatttgccaggtgcaatggcacgtgcctgtaatcccagctacttgggagactgaggcaggaggttatgtaagaggcaggagaattgcctgaacctgggaggcggaggatgcagtgagctgagatcgcgccaccgcattccagcctgggcaacagagtgagactctgtcttaagaaaaaagaagtgggtataaacatgagcagaacagccctgagctgctcttctctgcctgtgtggtagcccagcccagcaggcgcagtcatggaactgtaacaccaccagagctgtgacactgctgcttcaataaagccattttcttctgcctctggcttgcccttgaaatctttcctgggcaaagccaagaaccttcttgggctgagccccactttagggcttgcctgtcctacatcaccagcatagttgttcatagcactcttgctctaaaaagtgctcaagtttgagagggaaagggtgctacaaaggacatcattagaggctggatatggtggcgcacacctgtggtcccagctactcaggaggctgaggtgggaggatcacttgagcctggtttgttgaggctgcggcaaaccatgattgaacaactagacttcagcctgggaaacagagcaagacctcatttttcaattaattaattaaaggatgttatcagaacaactgacaacattggaatacagatggtctatcatgtaaaaatacttcttaatactagtggagatgtatgaagttgatgactgttgaggttatgtaggagaatacctctgttcttacaacacaaatgatacagcaaatgggatagaataataggtgaatctgagcagcggatatatggctattccttgcactatttttgcttttgcgactttatgtaagtctgatatcacttccagataaaaagtctaaaaagtagaagccaagtgctccaggttggacgataaattatatggtgagccagcacaggagcctctccagcaacctcaggtgacaaaatccaggtgacaaacgctgctgaagacaaaattcaagggggcaagaaccacagccaaggctgcagacaagctctgaaatcatttgatgtcaaaccgagtgacactgacagtagaaaccactgggtgaagaacagacgttacatgttacgaactttgatcacatacaaacaataataatactagaaagcgtggaggggttgggagtaaaaatataacttctaaacctggaacatctggtttacaaaagcacaagtccctttgttctcatgctctttcacggtagcttttagcatgtcttccagtgtctgtgtcccatgtagaggtgaagcttttatctcaagtgtttccttcagcttcactttggttcattcttgtgaaatccaaatgcagggaatgctttttctgataaactgtgcctgtgactaacatttctacttctgttcctctttccagttctactagacccatggggagagttgtcctttgtgagattgaacaaagttgactatctggaaggagaccttggagaatgcttttgacttcctcttggtctcctgtgttactgttattaaataggaagccaggcctttcttacaaaacaaaaccatgattcttatttttaaaggggaggaagaggcttagcaccccatgccatctgtctgagatctgagggccatgacactgctgaacgtccctcggtctccaggggctttctttcccacacaacaatggaggggatccctgccgtgtggtcaccggagttcttgctccgatgtggagcagtccagccctgcccctgcctaatcagcagaataacagacaggcatggctttctgcatcctgagttaatgcatgtgggcagtaggaccaactcacatttcacctccaggggaaatgagaggtgtgtttgttccaaacactgggattccaaacacagacctgtgaatggctttcattgttatgaagtcttcacctttcatgaaaacgacttcataagggctgctccccattcttcaaagcacccacccacgggctgcatgcatgttgcttatagttttttaagctgactttatttttagaacagttttgattgataggaatattgacaagacgtcacagtgtccctgtatcgccctcacacagcttcccttattattaaaattttacattagtgctgtacatctgccaccactgatgaaacagtattgaaacatgagtattgactgaagtccatgttctccatgttgaattcagatttccctaatttctccctaatgtccttgccgtgtcccagaaaggccccgtccaggacaccacatggcatttggttggcctggctccttaggcgcctctcaactgtgacagtttctccaactttccttgtttttgatggccttgacagtttttgggagtacgagtcagacattctgcaggatgccctgctcttgggatgtgctctttttctcatgagtgactggtgttatgcgctgggggaagaaagcagagaggcagcgcaccaccggcatacacatcctacacagggggtgcgctctcgacacggctgtccttgctgacgttgaccttggcccctggctgaggtcatgccgtcaggcatctctgctgtgaaatcactgtggggttctaactagggaaaaggagtcaggctgcagggcgcagaggaagtaaaaagaagcagcagatgagacaagtcaacccttcttcatggtgcaggacacacagccctcctgcacagataactcagtcttcctgtgctcagctgtcaccagaccctcggctgatagaaaaatgcaaggtagctccctgcaaccctggtgttatcagtactgcacgcagccctctgcagcccaagaaccaccctgtaaaacctctagcaagcctttgaatcctggcagtcagctcctcttctgctgagtctgcccatttcctcctcgcaacgtgttttcctattttctctaataagtctgcccttcattatctacaactgtcttgggagattcttttatgctccccctacctgctaccgccaccagcccagatagtcatcacccccctcgacagttaccacctgccttccataccacactcttgggaaggaagtgatggtgcagagcccacacctaaggagtgggggagtcacggtcccctccttgagggcagggtatctgcataaattatttggaatccttttgcaatggtgatttgtctcttctttcccacttagtttattcagtcactgatttctgtcagcactgactcatggacacctatgtcattatgggtcatgactcgaccctactttattttgtttctcaagttgttctggctttggccgttgggagctcttccagttggctcctgtgtccctttaatgtaggatttggagatttttttttagtacttcctttatgtagatttatcttgtatatttcttgccccagtcctagaatcagccatttctctgaggagccctgtttcgttttatggagaacagtattagaagccaagatctgggcactagctgtgtttatagctactgaaacataattgcttctaggttgtctcatgacagaggagagatatatgtatactaattaatgcacacacatatacctacaagtatttctagatgtaatcatttgtatctatattatgctaaacatgagtttataccaatatcttccattctaattcactaacatatgaatcattctagtctcatcccctggttttatctgtaaattctaacagtgagaagcctgactcccactacttatgatccatctccttaatcattcagtcccagcacacatgaattgtgggatcagattgtgaattgatgctcctgtgggaagcaccttaatcagctagagtgcagtgcttatgctcagttcccttttgcccttggtcttacacactccactcatttacacggtcacttagggcagcacctgctctcccatcctttcttcagtgaggtcattttacatatttggagcaggtagggaccagcgtggatggccctctggactgatgtgggggcccctgctttggaggggctgctggccagtggcaggggttggattggagccaggagggtctcaccacctttcctctcccgggactgacaccaacccctgtccttcaacacaacacaacacaacagaaaggggtttgagcccctggctatgttagctgctgtggtgcctcaggccagcactattccatccccaggaccacctgctcaggggtgcccacaccccaaccaccaagggctccaaaaggaaggtgtaagttccatggcctgtgcagggagggtgtgagccgtcccagcacaggcactcatttggaaccgaacagagggctggggaccgaacagaggcattctgaccccacagcagtggggagccatggtgggtccttgagcagaagggtatgctctgggatgtgtttgaacttgatgctgacagcaggtatggggtagacggagggaagatggagaccaggggttgccagggcaatgcccaacatgaggaggcccccagggtgcaggggaggaacaagggcagggcaggaggtgggggtcttggccaggaacatgctgtagggctaggaaccacccagaagagggtaagtctcatggctaggactccctcctggagcagaggactccagggtcccctgctctgtgccctcaggaggggagcagatcctccaaagagctggcccagcaggaggtggaataaatacccatgatgtgcctgggcctgcagaatgggaaaggtcttcctggtaatggcaggtggcccaggcctgtgagcggcactttcaaacatcagacttcacaggggcgccctgcctctcccagagccgggctaccttgatggctgctggcaagcaagtcctcaccatggttcctgtggggcagtcaggattcttaaggaggtgggttccaggcagggcagcaggtacctcggccagccttactgaggcccctggaggcccagcaaggggtgaccagtgggcacagtgaaaagctggaaaagaaagaatgaaagaaagagagaaaggagagaaagacagaacaagaagagaaagaacaagaaggaaagagagaaagaagaaggaaaagaaggaagaaagttttaaaaagttaaatatatgaaaggagcatccatccagaagtccaacagcagtccctcctggaatccattggcttccctcaagagtttttggtccttctctttcagggttgccagataaaatacagggtgcccagttaatctgaatttcagataaacagtgaataatttttttatcataagtatatcccaaagaaagtatggaacatatttaagctagaaaattattcattgtttacctgagattcaaaattaactagctgttttatatacatatatatgtatttcagacagagtctctctcttgtcacccaggatggagtgtagcggcacgatctcgactcactgcaacctctgcctcccgggttcaagcaattctcttgcctcagcctcccgagtagctgggactacaggcatccgccaccacgcccaactaatttttgtatttttggtagagacggggttttgccatgttggccaggctggtctccaactcctgacctctggtgatctgcccacctcaatctcctaaagtgctagggttacaggcgtgcgccacctcacctggccggcgttttatatttttatttgttaaatctggcaaccttattctcttgttaatattcttcagtgcttgcagctttgttttccttccttgccccctcttctagggcagacggatcccgttgtaggaaaagcattccactgtctccatggctgcagattgtggtctccgccagtggtgaggaacagatgggtttccacctgtatcgtagatggcatgtctgtgtcctccccaaatttctctgttgaggccctcacccccaatgtgatggtatttggagatgggccttttgtaggtaattagggttagatgaggtcatcagagtggggccctcatgatgggtttagttagacaagagctctctctctctctctctctctctcacctaccccaccttttctcttctgaccatgtgaggacacagagagaaggcagctctttgcaaaccaggatgacagccctcaccaggaaccaatccagctgccaccttcatcttagactcccaaacctccagaactatgagaaataagtggtattttgttttgaccgatacagcctgaaaacacattttctcctcaccacacatgagtgatatctgtgtgactgaaggtatccaggactcatcaaaaaaaaagagaaatgtcccctgcacaaggcccagccatgcccaggagaagcagcagcttggcacagaagagcgcacccaggctgggcactgcactcattcttcctgtgaccctgggcaagtcactgaatggggcttcagctgccccatttgtttatttcattttttttttaaggctagtcaaaattgcttcatttgtaatggggcttaatagtgtttgccctgcctcctgttgagggatccagagaaaggacgtcaaagtactttgtaatctgtaaggtttatctgacatgagaggaaatatacatatgctccaggatatctgtgtgcagacacacacacacacacacacacacacacaccatcacatatcaggcctggctgtgtcttcttacaaaggcgctgctaggcaccacctccagttctagaaccagaccagccagttcaccctccaggcattttacccttgacttcataaaacctttctacctaatccactagtgacaggctcatcccagacctaattttaaagatgtctaggagcaagattgcagagacttaccctcagcccctcgagctgcggtggaaatccttgaccttggcctacacaaaaacagatgcagatcattctcacatttgctggccggctgggctgagtgggcctggggaatgagggctacaggggcggtcctgggcagtcttgctgaggcttgccagcatctctccgcctccttaacttcccatggtccatgagcatggacttcaggaattcctgatggggggtgaagagcatgcagcagggtgtcccaatccctgatctatggaaagaaaaattgaagcaaaaccaagaacttagtttaagatgtcccatacaccagcctctagcccttgtttttggaacagacctctcccctggaaaccactttcctcccagcattaaattctccaaagtgctttgctttttcgcaaagttcccaaggatccctggagaaaggaagatagaaatgcctcactctctaaacagatagatgcagctagttaaaagaaacagccagcttctcttgctgtttctaacatatttgaaagaagcttgggttcagaaatctatccagaaagctccgtgctatgcagacagaacaagaaccttcccctgtgggagccttgggctggtcatcactggttccagagccagtttttctaaacacccattggtggctgtgttcagagcgagttagtcactcacaccatcctgccctgccctgagttaaaccatatatgatctcctccaggaagcctccatgactactgtagcccagggacatccccttctctgaaatgtacagcagttgaaacacttcactagacaccttagcccccatgttgtgctatttgggattgttcccggagagacagtagagcatttgactgaattcgcaaaagagaaaaaacaaattcattttacaaaacctaaactctcagactgaaggaatttcgcaccacagccacgataattcatgaacccacatctgctacccactgtggtgtctgagaggtgaaagagggcaatgtctccaggagggcgtgcacacacacttgttaacacgtgcacaagtgtgtgtattcacagggaccctgatgtacactcatagccacacacaagctaaggtctgagaactgtgtctcctggaggaggctgggatgccggacacctgaggaagcagccccgagctccactttcaccagcacccctagagggtcagtgccaaacggaccccattatttcatgccaatccattctagggggtcacctcccccgaaacacctctctgaaacattagtggatgccaaaggggaaatgagacttgctttgcacaatcttcttctccagaggactgcatccctcatttcctaatggacataaataagaaaatgggttttgctttgcagaatgttcttctctataggaacatagctcagatttctaaacagtgtcctaatagaagttacagcctctgtagccaaccacaccaatctggtgtggttgaccctcctgacttgctgacattggtagactcctgtgtggcttatttcttcatgcaaccatgaacatcctttctccacccacatcagaaggatcttctaaattcatccctctctctcagctgcttccagctccccaaaaggcttcccagggcaattagaatgcaatccaactcttcccaaaaccccgacatgggagcagcctgggtcctgtggcctctcccactggcctcttagcctcaatgttcagccacactggccttgcccgcccacactgtttgtcactgctccagggcctttgcacctgctatcccttttcccagcatcctctttccctgtcccttttcagagcagcacacagaaggacacaaggactgagcctcatccaggaatccagggctgcaggtctgagcagagggtccctgggggcaaataaaaagcactggggattctgaaagtggcagtagcagctttgcccttttcagaatggcatctaccatttagattctctacagtttatccagcccagccctcactttacagaagggaggccaagctggggtcacaccaactataaggctccacaacctgggccaccccctagtctgcagctgggccattccaaggcttcttcagggctgtcaggaggtggtggggttcccttggttgggaggacagagaccccagtgctggctaccagcaggaggggagctaacagacttggagtcccctctcatggagccacaacaaaccaaagggttagggatttcaagggaacaggggtccctctggggaaaaaagccagggttccccggagctactgttattgccctcctgggagagggcaagtacttacttggctaatgtgacctcccttgcgctctggtcttggaaacagctgccacctttccggacatgtccaggaagctgcccaggcccatgcatgccctcccagcccctagtctcctttgatcaacactctgacctcccagcccaggggggcccggggcaggagaaccagaacagtgcccggcccacagtcccaactaaggaaatacatcctgatggtcaccagccccttggacatccaggaaatccacagaggccgggatggcagcaagggagccaagtgccatgtgctctgcaagccttctttctgcagagcctactgtgcatcagctgagggtccagagaacctggctggggtggcaatggcccctttccagatgcagttcttgggcccccagaagccagccaagagccgttctcatttgtgtgcatggtgggcacatggctgcctgtgtttgtgtctctgtgtttaaaccaggaggagttaatgattaagaggcgccttgagttcggtcccactcaaaataaactaggacctgtcagtaaacatgaggggaacctcccagttgtcagtcatctcccagtattcccagaatgatctggggtagacatctggcatgactggatggtaacttgggggctgcacctgtagtgtcagagagagacgttcttgatagctggagacagccctggcgatgtgacataggtaaaggccttgggcactggccagtggctctccaccccctgtagaagtaagtgtccccatgggctgcagatgggctgcctagggtggaggtggtttgctgttgggaccaggagccagaagaaggggccagggaggaagaaccctggagctgtctggggacttgtgctggaggctgtgcccacttgggcagatggtcaaggtgcagaggacagcccagtttagcccagccacagacaaaggtgctgagactctggggctctgtgcctgcctggcacaagttatggagccaggattgagtgggcccctgtgctctgggctgcccaaggatgagactggggcatgctgggatcaagatctgactcctgacaacctgggctttgtgtagagcagataggggagtaccccactacctgtctttccatgccgccacagtgcagtgcccagagtctgcaaccctcactccgggcatgggccgagaaaaaatggaccctttagctggtgcactaggcaaccttcaggctgtctgggaccagccctgacagcctctgctctgggatcagctgccgcagcagcctgcacatggcatggggcagcagtggtggcaaccctggacactggcccccatagcatggaacccaggaccagacactgccacggtcagcccgcaggtgcgggagggcaggaggcgagcagtcacaaccctgcggctgcacagtgcccctgcaaacctgtgctctgggccagggccaagagaaattggaccctagcatgggagagcggtacacttggcgaccctccggccctctggaagtaaccctgccagccactgccgtgggctcagccacagctgccacctggaaatggcagtagtcagtatcagtggcaacccctgatcctgccctcccccaccagcagcagggaacccaggaccagttgtcgccatggggtaggttagtgagggatttagggtcatttgattatgagatgaaatgatcacatggggatgaagtaattcttttttttttttttttttttttttttgagacggagtctcgctctgtcgcccaggccggactgcggactgcagtggcgcaatctcggctcactgcaagctccgcttcccgggttcacgccattctcctgcctcagcctctcgagtagctgggactacaggcgcccgccaccgcgcctggctaattttttgtatttttagtagagacggggtttcaccttgttaaccaggatggtctcgatctcctgacctcgtgatccacccgcctcggcctcccaaagtgctgggattacaggcgtgagccaccgcgcccggcctgaagtaattctttaacataacatcggtatgcagaagtacagtatacagtgataagaatttacaatatagtgtgtgcgtcagcaatttctaacagagccttaaaacataaacacagcctatccataaactatgattagcaagatattaatcagcagtaacagttgcagcaaaagctggttacacacaatccatagaaacaggatgtgaggctagacagcctgttagaccagaaattctcagaagggagtatgccttaaccctaaagagacctagaagagccgtggcaagatgagggcatttatagccctaacttatctgtatgggcaagcaccccccatgcgtccgtttataggctctccacaagggtcgcattccattcccagagctatgaacatctgcttttctgggctaggaatcttggtgatgtgaaacctccctgactgcacgaccattcacaggctctctgcagggggaagcacatcacgtgctgttggctcattctggcagcccaacctggcattgtctttacacaatcctgcatgctactttgtatttacaataatcaggagcatttcatcttttattccgtagcaatagtttcagggggtctccccacagtagtgaggggctcagtccaagtccaaggtccttcagggaagccaatgttgttactcagtccaagcaggggagctgctggtgcaagtcttggagttcaaatgccagagaacctggagttctgatgtccaagtgcagaaagagggttgccctgctccaggggaggaagaggattcacctttgctctatctgggccctaagcaaattagacaatgctaaccaacactaggtgaggatggatcgttcttacccagtccactgactcaaatgccagtcccttccagaaacaccctcacagaaacaccagaactaccatgttaccagctatcggggcttcctttcatccaatcacattgacacataaaattaatcatccaattgtccaaaggcttttgccacctggctgaaacccgactctccaatgcatgtgccatgttctcaaaattcctctccatctgctttgacccctgaacactttcttgaacacattccttaatgcacactgtgtttatttttctgcctagaacattcttctctaacatctcaccatcaacattctacctagtactcaatatcagtatagatgcttccccaaccccatgaattttcccagttgagtgactttgggaaaatgctgtgacttctctgagcttaagctccatcgcttgtcacataaaaatggtgagactgatacaacaatgttccagtgaggagaaaaaacttttttttttttttgagacacagtcttgctctgtcgccaggctggagtgtagtggcatgatcgcggctcatggcaacctctgcctcttgggttcaagcaattcttctgcctcagcctcccgagtagctgggactacaggctcacaccgccatgcctgacttttttttttttttttttttttactagcgatggggtttgaccatattgcacaggctggtctggaactcctgagctcaggcaattcaccgcactcagcctcccaaagtgctaggattacaggtgtgagccaccacgcctggtcgaggagaaaattttatatattgagtgcccagtgcagtgccttgcacatattaggtgacaaatttttaactgacccttttcatgaatcttctaattccttccaatcagaatgagcccatgttctctctatatgcaggttattatcaatacaaaaacactaatcaaaaattgtctttatttaagttgtcaagctgtcctaactcctgacttgtatataaattatgtgaagggaaggattctgtctttttgtcatctcttaccctccccagttcttggtgaacagcagacagtcaaaaatgattagaagactgataaaattcactgtcatctgttcaataatgccttccttgtttccgtaatatacctcctcccaacttctcaggaaatctgagagtgccccaagcctcaacttccaatatgcaactcctttatgggccttctgcaacactggcctcctcttacctttggaacatagaacttttgtctctggcagatgagggctttttaatctagaatagaactggaacaaatcctctctcacatcagcaggagcacctatgaacacactgatcaagtgttgttgagacacaagtgttgtctctgtagggaaaggtgtggagacagagagccctgagaaggcagaattgccaggtgagatgtcagggtggcattggtacaggccgttcagctggggaggggtgtgcactgctgagccacagaaagcaagctttggatccaaggaacagtacataggaagtggattaaatgtttgcaaaaaatagaaaccatcctcataaaattaataaaactaaattgctagatttttaaaaagagtataacctgtaagtagaagcatagctaagttgttaaccagctttccctaaagcccattttcttttttttgttgttgttgttttgagacagtctcccactttcacccaggctggagtgcagtggcgccatctcggctcactgcaagctccacctcccaggttcacgccattctcctgcctcagcctccctagtagttgggactacaggcgcctgccatcacacctggctaattttttgtatttttagtagagttggggtttcactgtcttagccaggatggtctcgatctcctgacctcatgatcctcctgcttcgacctcccaaagtgctgggattacaggcgtgagccaccgtgcccagccaaggccactttcttatagctgcttactgcttcaaagtcacccctgtcacaatgtcctaacttctatgggggacacctttgatcttaagaaatttcaagtttttcattttgagtttttttcagatcctgcatttcaatgagtccactgacaccagccagtctgaagaccctctccaaggaactgactcagcacatgaatgtgaatgtggtttcttcatctccgtgtcccatgatttcatccctcatgtcttgaccaatcagaaatatccacactttagctcattactcatcctttaaaatcctatccccagtcttcttggggaggcagatttgaagtttcctttcatctcctcatttggcttccacatgattgttaaactctttattgctacaactcctgctgtttcgaagtattggtctgttactgagcaatgaacaattgaacctggtggccctataacaaaatcactaaggactcaggtagactttagtacaatgccccgtgtacagccttaatattgctcactgtcagctactgcatcccctaaatgtggacgtatccaggaagcttcttcccttgcagaaaacacacaatactgagccctggagaacaaaacaaatggggtgaggctaatggggagtggggagatgttgattaaagcatacaaaatgtcagacaggaggaataagttcaagagattgaacaacatgatgattataattcataacaattgtattcttgaaaataagagagtaaattttatgttctcatcaaaaatataagtatgtgaagtaatgtttaactacttcagtgtagaaatttgacaatgtatgcatatttcaaaaatgtgtgcatatttcaaaaaatacatgaaaatatatataatttttgtttgccaataaaatgtcccaagtgaaaaagcagaaaatgttaaaactccacatatgattatgccactaaattgatggtgtctatatttttattttcaaaaaaagcttaaaattgagttttagaaagctgttagctgtccatgtgctttgaaaggctctccaggcctcttgaaccccagagtgattttagtccattagtctaattatttatgattaggaggcagaaacagggaaattattaatcataaaagatatgcctatctgtttatcttcagatttacaaaaaagcaaatgtttcattggcaaaatttacatcttactgcatgtacacaggaaaaaaataagtactctcacataaaacaagctaaagggacattcacttggttttacttttccagtagacaatctttgttgaacttaatctatgatagcattggtgaattctcatgtttatatttatactatgtggaaaggtcaagtctaactgtagttttttaaataattgagaggaaacaatgtagagcctccatgagagttttgtataaagataaaacatttgaagagagaattcttcttcaccaccagtcttattgattctaaacacaacttttaccaagcagacaaaaacaaaactgctggatgtacatcaccaccctcagaaaaataacttttgtaaaagagaactgacaacattcagtctttaaaaaggaaaatttcaggcactgttccacgcatgaaagatagccccacatcagtgaatcaaatttagtccaaaaaatggacattagacaggactactgagtagtagtatgtcaaatgtttgagaaaaattctgagtcaaactatggtaattatgaaccattaatcaccatcagtaaggaaacattttctgagctgcatctacattctcctgtgtgatcgcaggtaaaacactcctctctcagttcagtttgctcatctgtaacctgaggctagagggagcacctcctcatagtgccatggaggagggaatggaaggaagtgtggcaggtagcaagtgatcactcaccttagttgttatgattttagtcaaccattgcacagagttttctctgaagcatgtggaccagctattttccaccttgactaataaattaacagagaaggaagaaccctgcagatcaaaatcttgtcaaatgcttatcacaactctgcaggtttcagaacatgtaaactagttgaaatctcagtttaattttgtgcgtgcttagtccagcaaaacctgggatggacaaatacatattgtaaatcagaagaatgattgacctttggtaaattgctgatgtttctaaaaaggtcaagtatttaagcaggtagaaagtcagctaaaacactcattcaaagaacacacacacacacacaccaaaaaacataaacaaaattgttttcccttgggtgtttataaatacaatcttaatagagaagcaactgtagattgtaggttatctctgcaccatgaaagtgtagatactcagtacttgctctgcttcatggctctgtctgctttaggtgttcataaatttggttgagctgcagaagcatttttttacattgttagaagagtagctaaaaagactatgaagaccgctgaattattagaaagtatgaaatggcctctcatggattgtaatgaaaacatagtccaggctttgtgctttgaacaaaatacagtcatcccttctatttgtgggggattggttccaggaccctcatggacgccaaaatccatggatgctcaagtctctcatagtgtagtatttgcatataacctatgtacatccttttgtacaatttaaataatctctagatttcttatgatacataacacaatgtagatgctatggacatagttgttttactgtattgttttccatctgtatttttttattgttgtgtttttctttttgatattttctatccatggttggttgaccactggtgcagaacccatgcatgtggaattggagggcagactctactagccttagagtcagaagaactgagttttgattgccacctgctgtggtccatcctaggtatgttgcttagctataataatggttcaagtaagatgctatccaagctgctgtcttctagcatgttcacaagttcatccgatgacagaccattctgtcactagaccccaggtacctaggaattttgggttccaactttaagaattgttggttttatccttgatatagtttggatatttgtcccctcccaaatctcatgttgaattgtaatcctcagtgttggatgtggggcctggtgggaggtgtttgggtggtaaggacacatccctcatggtttggtgctgtcctcatgatagcaaatgagttttcataagatctggtcatttaagtgtgtggcaccccctcctccctactctctctctctctctttcaccatatgatgcgcctgctccccttccaccttctgccatgattgtaagctttttgaggcctccctagatgctgagcagatgccagcaccatgcttcccatacagcctgcagaaccgtgagccaattgaacctctttcatgtataaattacccaggctcaggtatttctttataacagtgcaagaatggcctaatacagtcctcctacagaaaagtactgggatcgaatgagaaactttgtaaaaggatccaaaggaaagaaactacccaattggataggatcagaaaacaaaagtcctgcctctctctgggagaagcagtgatcctaggaacgattaatgtagggctatgttcaggttcagagctaggtgaaggtaacagtggagggaggaagcaggcagtgagggagaagagtggtttgcaggcaaatcctggtaggagtctagaaaaaaaagcaatacactggaatgagaaataagcaatctcttttaatgactgggagttaatgttcataaacgagtgttagcatcccagattcatcaaatattaaaaatgttagtaggagctctgggactactcttctttcctctatctccttggtccctttaatatccaacatgccagaatttgcctgcaaactgtacccagacccagagattgcaacttagacacaccttggtattcattttccttgaaaaactgtgaagtaagcacttctcaacaaagatttaatatattattttaaaggacctatcttttttccaacactgtagatatgggagagtcatttaagttctattatttttcaggggtgtgattgatgtgatgagtgccaggtggagttgaaatgatgggctcaaattctgacttgaggttgggcattcaaatgacagcaatagggaacccaatcaggctcacactatgataagtttgagcaaaggatacttataaaaatgtcttaaaaacactttcattttatctctttaaattctaaaaacagatttaatgaaacggtgtatacttccaacaagccatttatatgcactgtcaaagtaaacaatgtaatcacactacatccattagcgttttgaagcaatgatgaatatttatgcatttaaaacaatttgaaacaatgacgtggatgtcacatttttgtttacattgtagtgtgtctctttgatgcactgtaaataggataagaatgttatttttgagcagaattttggacttatttttcctcagatggaaaatcacagtttatgttttttgtttgtttgtttgttttttgtctcttgtacattttccttcattcatattatctgctgcctgaagggaaccaaaatacaccactgtgacatagtgatattttgagctaaagacattggagaatcaacagatacagaatgaggttttttggtttgtttgttttttctgaaccttccttatctgcctaaaatcagagcctccaaaaataatttaactgtcataaatatcctccccagaagtttcaaccaaggaagatggactcctatcacagcagagaagttggcactaggataagaaatcaccaaagcaggtacacaatttggagaaagcaaagggaaagaaccaaagtgtgcattgaacaaatgcaaattttgtgaatcttcatttttaatgatctttacatatatatatgtgtatatatatatatatatatatatatattacaaaacagtaaatgatcactgtgtaacagtttaaattaccaatgtatttgattttactggagaaacctaggtgccaataaataaataaaagacatcaccgaagcagacattgtcacaatgctactggatctcccccatctgtgctccgaaggacccatttatctttcctacaagtcatttcttttcccatgtgtcctttctcccttttcccttcccttagtaagataatatatgagccctaaattctaacctcctctttgagccacatagtctgtgagttcccatgtatgttcataaataaatgttgcccttttttgttgttggtttaacttacaggcctcaactactgaaccttaaagggtagaaggaaaggtttcttccccacatgcccaagagccaacactagctctgcaaagtctgcatttctcacatccaatttttttttttttttttttttttgagacggagtctcactctgttgcccaggctggagtgtagtggcgcgatctcggctcactgcaagctccgcctcccaggttcacgccattctcctgcctcagcctcccgagtagctgggactacaggtgcccgccaccacgcccagctaatttttagagacggggtttcaccatgttagccaggatggtctcgatctcctgacctcgtgatccacccgcctcggcctcccaaagtgctgggattacagacctgagtcatgctgccctgccacctagagcttccttttctaatgagcagtgactaacggcatcttgggtcaatcaaagggtttcattttcataatttctgtgatgtcaaaccaacccgtgaaaatcactgctattttcagtactttaacttctgcattcatacaaaaagatactgaaagaaacaaaatcctcagaatcaaagcatccatgaccattgcacaatgcatacatttccaacggtccctagttggtttcatgtgagttacatcatgtactggtgccaggaatgcctgcctacaagcagcaattacaatactttttattcttttcttatctaaagtaaatggaaggcattcttgctttggccttgatgagtgacagtgccctttgcaaactttgagaggcttctacattttcctttgtgctatagtgatgagaaggaaatgctttagaatacttctcattggaaactagaaactctgagataggagagaattctgcaaggtattgatttctcaggggccgttttccttaaggactagagaaattctctttaaatcctgtaaaacacaatcattactgctttgtaccctctctgttaaccagagggcttgggtgattatagatcatagactcagcaaaagcctttaaattttggaagggaatagaaagcttaaaattcacgcttgtgggaacccctgaagagcagataaatgccctttgtcttctctgtactccccagtgtgttttgcctactgttttgaatgttcatgctattttttgcctgacaaatgtctactcttctaagaaacgttatttactgtggttatgaaaggaatttattttgattttagaaaatttaaaaatattaaaagacataaagagaaaaaagtctccttaaagctatccaattatgagtcatacagacataactgctgttaccactgttacttcttgagtgtgtgacattctagacattcatctgtgtgaatacatgtgtatgctagtgcatatatttacagaaactgtgtctaaattaaaaattggaataattatgtagttaactagttatctgtctagtttgacctcatactatctacctatccagtcttgtttgatattatttaaagtataattttcccctaatttaatagtccatcatatcccatatactgtgaactataatttatttaatcagactcctttgtattggaaatttagattgttcttaatttttaccattttattattactggaataattttccttacttttattaatttcttggtatttttgaatttttgacctaggaaaaattcttaaaattagaaatagaggtcaaaggatataattttagaagtctaacgcattatccatggcaccacagagccagctataattttaaaagcttttgatatatatatatagctaaggatcctacaaaaatgtatgttagtgtactttctcagcagaggatgagctggaaatatttcaggccatttgatgtaaaagtttgctttgctttttactattaatgtaattattttgatttctgtgcagtgaacatcttgcaagtgttcatttgccttctgtttgttacttttattactaacttggtgtcctttgctcatgtttccatggtgccatttttcttttcttgaccattctgtggcaatcaaatgtaaaataatgtttatctgacatgtactttgagttttctttattatcactttggattgttatgaaattttttatacccacctcaaatctgtatatcaagctctgtctcacaaaccttgtaatttataaggtatattagatattacatttttattgaattttatatcatataaaagaaatctgcaatgtaatatgataatgctatggagaaaaaaagtaccatatacattggaaatattaccaaaaaactaactttcaggtaacagggattcatcttaactgaaaatcaagttgtcagattaaaataattctattgatactttcccttacatagagcaaaatgaacaattttgaattgttttccatattgttttttgtaccacaaagacctgagagtaggattccaagatggaacagataatattttacgcatctcttcattttcaacaactagcacatagtagccactcatacagccctacctgtccccaacccataaatagaaaagaaaatgaaggccgggcgtggtggctcatgcctgtaatcccagcactttgggaggccaaggcaggtggatcacctgaggtcgggagtttgagaccaccctgaccaacatggagaaaccctgtctctactagaaatacaaaattatccaggcatggtggcacatgcccgtaatcccagctactcgggaggctgaggcaggagaatcacttgaacctgggagaaggaggttgcagtgggctgagatcgtgcctttgcactccagcctgggcaacaagagcgaaactccatctcaaaatagtaataataataataataataacaataataataataataaaataaatagaaaagaggccgggcgctgtggctcacgcctgtaatcccagcactttgggaggccgaggcgggtggatcacgaggtcagcagatcaagaccatcctgtctaacatggtgaaaccccgtctctactgaaaatacaaaacaaaaaaaaattagccgggcgtggtggcgggcgcctgtagtctcagctactcaggaggctgaggcaggagaatggcgtgaacccgggaggcggagcttgcagtgagctgagatcgcgccactgtactccagcctgggcgacagagtgagacgccgtctaaaaaaaaaaaaaaattaaaagaaaaagaaaaggaagctctaggcaagaaagaaaggaaaggaaagtgaaggaaatgagggagggagggagggagagagaaaggaagttaaaatgaaaaaatgaagaattagtttttcatagaagatttttaaaagctctggtgcattcctggaatctaaaaggccacatgcatgtgcaggactgtgtacacggccaagtaacacatgaaagggctctcactcttttttttttttttttgagacggagtctcgctctgtcgcccaggctggagtgcagtggcgccatctcagctcactgcaagctccgcctcccaggttcacaccattctcctgcctcagcctcctgagtagctgggactacgggtgcctgccaccatgcccggctaattttttttgcatttttggtagagacagggtttcaccgtgttagccaggatggtctcgatctcctgacctcatgatccgcccgcctctgcctcccaaaatgctggcattacaggcgtgagccaccttgcccggccacggttctcatctttcaccactttatggctttgaggatctgcacaaataggaagtaaaaacaaatacatagttgcaaatggtgtgctggtgcattggaggtatgtcccaacacacatactgaacccctaggcaaaggatgggagactaactggtctaaaatatttaggaaaatctttgtcaaaacattagctgaccactaagctatccaagccaagccttcagtgctacccatgacaaatacagaaagtcactaaacaaacagtaacagcagcaacaacaatcgcaacacaaacaactaaataaataaacaacaaaaataaagtaaaaccagaacagaaacaaaacaaaaaagtgccgagaagtatctgatttccaaaatttccacattatcatatttaaaattatctagtctttaagaaaaaaaatgagatatgtgaagaaacaggaaaggataatccatacaccgaaaaaaaggccagttactagaaattatctgcgaggaagacaagatattacatatactaggaaaatactttagattaactggtaatatgtttcaaagaactagccaaaatcatgtctaaagagctaaaggaaaatgtaaatgataactcacccaaataaaaaacaacaacaaagagacaaaaattattttaaaagaagcaaatagaaattctgcagtttaaaagcacaataacttaaatacaaattcactggagaggtcaccagtagaattggagtgctggaagaaagaattcatgaacttgatgctaggtcagttgaaattatccagtcttaggaacagtaagacaaaataatgaataaaaaggaatggaggctgggtgcagtgactcatacatgtaatcctagcactttgggaggccgaatcaggcagatcacctgaggtcaggggtttgagaccagtctggctaagatggcaaaaccccatcaatactacaaaaatttgctgggcatggtggcaaatgcctgtaatcccagctactcaggaggctgaggcaggagaatcacttgaacccaggaggcggaggttgtagtgaactgagatgccgccactgcactccagcctgggcgacaagtgagactccatctcaaaaaaaaaaaaaaaaaaaaagaatggggagtcagacagagacctgtgagataccatcaatcatactagcttatccgtaatgggagtaaaagttatttaaaaagtcacacattaaatacaagggatcctcactaagaaaaccatctgactctcagcagtaaccatggaggccagaagttagtcagatgacatattcaaagttctaaaaaaaggactatcaaccaagaaatctatatctaacaaaaaacatccttcgaaactgaaggtgaaattgacattctcagaaaaacaaatatttggaaaacttgttgctggctgaactgtcaaataaagaatactaaggagaatctgtcagactgaaattaaagggcactggaaagtaacctgagtccacatgaagtataaagggcaccattaccagtgactacgtaggcaaatgtaaaagaaagtaaagcataattttatttgtgatacttttcttcggctatccaatttaaaagacaatggaatacatcagtaattataaaactgtgttggtaggcttataatgtcattattattacataaaacacaaaggagaagaaagaaaataaacctatattggaagaaaattgtgtgtactattgaaattaagttgctgttaacatgcaccaaaattttaaagttaagatgttaactggagtcccgagggcaacaactaatggaattgctcaaaaaatatatagtaaaaataaataaaggaatttaaatagtatacctgaaaatatttatttaataaaaagagagaagccataatgaatgaacacagaatcaaaaaagacataagacaaatgaataggtatatggcacatgtaaatattaccttatcggtaatcatattaaatgtaaattaactacacactccaaactaaagccagagattagtagaacacatttaaaaatataatcaaactggccgggagcagtggctcacacctgtaatcccagcactttgggaggccaaggtgggtggatcacgaggtcaggagatcgagaccatcctggctaacatggtgaaaccctgtctctactaaaaatacaaaaaattagccggacgtggtggcgggcgcctgtagtcccagctactcgggaggctgaggcaggagaatggcatgaacctgggaggtggagcttgcagtgagctgagattgcgccactgcactccagcctgggcgacagaaccagactacgtctcaaaaaagaaaaagaaaaagaaaagaaagaaaggagaaagaaaaagaaagaggagctctaggtaagaaaaagaaagaaaggaaaggaaagtgaaggaaaggagggagcgagaaagaaaggaaggggaagggaaggagaaggggaagggaggggaagggaaagggagggaaagagaaagaaaagaaagagctctaggttacaggaagtgggctttttggtgtgactattaggaagaaaaagtattaaaaataatcacaccaccgtctgtaattttgtaatttagaatagtccaaataaggaaaaaaaagctacacaataaaggtaacacagttaaaacagaaagctgcctatagctatatataaagtgtttaggacagtagctggcacaaagcaactgtttgctgttcaaagaacaaattgtgtaccctgcagcaactcacatttctagttttccatctttctgcaggaccaaggtgagattttgattaaatcatcaaatttgctaattatgtcacaaaagtagctatccaaaagtgctgcaatagggaactatttatgcattctttaatattctttaagtatcatttagctaattttaggtaaaagcaaataaatgtataatgctcatttttaatatacttatagtaagttgttttctacattgttttaataaaatataaattaattatttctgtcatgtagtttttttgtttgtttttgttttttgtttttttgagacggagtctcacactgtcgcctggagtgcactgggctggagtgcaatggcattatctcggctcactgcaacctctgcttcctggtgtcaagtgattctcctgtctcagcctcccacgtagctgggattacaggtgcccgccaccatgcccagctaattttttgtatttttagtagagacggggtttcactatgttggccaggctggtctcaaactcctgacctcgtgatttttccgccttggcctctcaaagtgctgggattacaggcaagagccaccgcgcccggccacactcatgtagtttttagaagtcatcttatcttgagattgggtgaagagtgagaaaaaaatcagtgggaatattcccacaggaagtcttgaattcattcaggaatgaattaatagaactttggattaaagttgactctaggtaagagtgatcaagtcaacttgaacatcttctacccttagtcttgagccaagctcctctattctctgttccacatttccaggtaacttcagttgacataagggttgactgccttcaggtgcattgtgacagctgagatttgtcaacccaggaatgagaattttttttcagataacactaaacgtttcagactgtatcacacaattctacagatatttaaaaattcattacatctttttattaaaataatttcaaaagaatttaaactatgaacaaatgcaaagaaataaaatactaagataaaacattaactcccattaattttcaagtcttctaaactcttattgaatttaatcttattaataattttttctctctgacatgagaagaaaaaaattgctgtaatactcttttatgagtcaaaatccttctgaaaagtatttattattctggtttagttcttcagaacagataggtgttaaaatttcttacatatggttttgaccctttgtgctgctacaacaaaattctacaggttgggtaagctacaagcaatagaaatatattaatagtctcatagttttggaagctgggaagtccaagatcaaggtgccagcaggttctgtgttgggtaagggttgctctgtctcgaagatggtgccttgttgctgaatcctccaaagggaaagaatgctgtgtcctcacaagtggaaggcatgaaagagcaagagagtgctctcttcaaacttgtccccttttattagggtgctaatcccattcatgaaggcagagtcctcatgacttaatcacctcccaaaggccgcagctctcagtacattagggattattcaacatgtattttagagaggacaccgtcatttgaaccacagcaaccttttaactgaaaaatcatgaaaggtcacatttaatcacctgttccttacagccttcctagagagtcacaaaaagagagagaaaaaccaaaaggaaaagaaaataaacatgtactgacctgcttctatattacaggcactctcttaggtaatttacatgtgaaagtgtattgaaagcagtagatttgttgaagtacaaatcaaaaattattttagtttttttcctatctcttccttcaaactttattacatctctcttgttcgccatcagccctttggataagattccatcacttttcagtagtttcccatctactagaacagtgtcatttttggaaattataatagtccagccgagtgcagtggctcacgcctgtaatcccagcactttgggaggccgaggcaggtggatcacctgaagtcgggagttcgtgaccagcctgaccaatatggtgaaaccctgtttctattaaagacacaaaaattagccgggcatagtggtgggcacctgtaatcccaactacttgggaggctgaggcaggaaaatcacttgaacctgggaggcggaggttgcagtgagctgagatcatgccgttgcactccagcctgggtgacaagagcaagactccatctaaaaaaaaaaaaacaactataatagtccaatttagtctaaaacctgactttattgtcatatcatactcaaatatctgcccttcccccaattcagggaccagccataattaaagaaagatacctacactttcaccttgctcagcctttcctcactctctcctccaccttctgactcttccaggatcagagcaaagaaaatgggtgttggggggaaaggatgttggaaggatagagtcttacccctgagctggtgctccccatggtcctcactcagctgagaatgactggctgctatgtcctctctggcagcctccacatactgactctcttgtgtggcacgtttgtgcattcttcaaggcccaactgctccctcctcttcctggaatcaattttgggctacagatttgcagactttaaaattctcgacgtggaaaggaacacatcagagtcaatattaacctatgttccctcatcctggggacagatgacaggtcctcacaagaattattttgccttgctctacctaaatggctgtgtccaaatggacctacaataaaactagcaggtgattacatatcttactttcctttatggactttttgtctccagaagagttttcttggagtattccctcttggcctattgggagggaaaaacatacttttatctcctaaaaagaaagtaggaaaaaaaaaatcttaacactctctgcaacttaatccactcctgaaaattccattaaacattatccttgcaatttcagatctcctcttgtagactatagaagctcgatggatgctggatcatttctgttgcattttgggaatttctgcttggacatatctaatgattctcattagaatgtggatgtacttgttggtcatttagcaaggtaacaggaaaggttccatctaatattttattacctattcaatatctcatttaactctgacaaccatcctacaatgtatttattactgtttccatttataggggagaatgccaatatcttttgaagttaagtacctcttcaaggtcacatagtaagtgcacccaggttttggaggatgtatctgacttagaagatatatctaactatgtatctcttcatgtaccctctgcatcaggagttctggaactttagggtacatcagagtaacctgaatagcttctcgtaatacacattgctaggcctctgaacaggtgtgagtgaagacctagaaatttgcatttctatcaggttctcacagaatgccaatgctgctggtctggggattacacttaaagaagctcttgttgcctcatttatgaaaaggtgaaaggaaaataacataagaatgtacctcctccacaaagctgtccttccacactgtcacacttctgacaccattctttggaaatccacatacaatgtatttccttaataccatttctaaattctgcagtttttgtttttgtttttgtttttgtttttgttttgagacagagtctctctctgttgcccaggctggagtgcagtggcatgatctcggctcactgcaacctccacttcctgggttcaaccgattctcctccctcagtctcctgtaacttgggttagccagcaggcccagctaatttttgtatttttagtagagacagggtttcaccatgttggccagactggtctcgtactcttgacctcagacgatccatctgcctcaatctcccaaagtactaggattacaagtatgagccactgcaccaggccaattctgcaatttttatatcctccattattgactaatgcaaactgcttttctcttaactgtccaagcttctttatttcctttccccaggaaacacttgaaaacaaagcaaaacaaacattactacacaaaaataggcagtaactttaccttgcccttctggtccttcccaatttggtgggtcttagtttcaagaccttttttgaaccaagtttaagccctcaaagacactaggaaagaaaaagtagaactgcatcaaacaagagggacagtgaagaaccctgataatgggactggagcacctctggatttgttttaggctctgactcactgcctccatggctagacttctctttcctggaaatgaaagggagggctgtactgaccgctcttccagtgttccagtgaagatctggattttatcagcagtggtgatgttagtatcagactctaggaggtaggataaatctctaattcattgttatttttaattttcattttttctattacattgctacaacaccaaatgatgtttgattacttttcttccttggaaggaaaaaacaaaaacaaataaaaaccaattagtgtgtctaaagacagtcaaaatgaggactgaaacttgttatcttttcactaagggaaaaagacagaaaattgcctcccatttcatggtattcttctcaaatgctgaatatggcacaatctacttacctaattatatatgatttatgaccatttccactgaagctacagagaggaagcttgtttccaaagacaatattcagttttatgaaactcagcaggtaccgcataagtctgctttttactgcaaaaggcataattacttgtttagaaatgagagtgtgagagaactgatgagaaaaaaattaaagtgaaaaacttttgaaacatagtgatttacagatactgttaagcacatttataaatgtggccaaggtgaatagactgtgtgtaaacttcaaacacagacacttaaagaagaacaatgagaactccaaatgccttcaccagtgactcgtctttgagatgttgccaactggggaaggtcagcatctctgggcttcccttcttgcctgggtagcaaatcaaagcctcccttattgagctggcattgattgtatagaaatagctctgtagatgctctttggcttcgcactttctcagctgttttcttcaggaagtaaacacttttgttttaggactcacatctatttcccattacaatgttccagagaaaccctcacattgaagaaaggttggtttgtgcaatgtaatcatcatggcctctatatttcatatttatttctcttaggcacaaacaagtcacttggtctcacgtttttgtactcccttctgttacaaatcctgtgctcagaaggcttgctcaacacattataaaatgggcgctttagctaccaatgaatataagtttcatttgactcttagcacttcctgaagcataaaatcaggggtaaagtcacagcatggtataaacaaccaagtaagagcaataaagagaaaaacatcattatgtgattttggtagaaatggtagaaaaagaaactgtgttacatgtatctgattataaatatgagaaatccttcattgactcccagctttaactataaaatgtccttgaaaatgaatttaaactctttttacactgttcactatcttccaaaatatttttattgtatatatttaaagtgcacaacatgatgttttgatatacatatacatagtgaaatgtcaagcaaattaacatatctatcctccccaatacttacctttttgtgtgtgtcgtaaaagtacccaaaatctactgtcttagcaaatttccagtatacaatacaatattattaatgataaccctcatgttatacattacattcctagacctattcatcctttacagctgcaactttgtacttttttccaataaataacaaaactttggctgaaaactaataatactacattttgagaaattagcagcaaaattcttcgagtgaagacaaaggcttttttaaaaaatagagtaagtagtagttaaatgtattttggtagattttagagctctcaaatttctaagatattcagtaagtcagcttggaaaattattttatatatcagataacttgaatctagagaggttgggtctttcacaggagagggcagtggagtgaaaattaaaacataaaaatgtaaacctctagaaacatttcttctccacagaaagacatttatcatcaactggttatatgttgtttcatttctttcttcagaaaaactcctatactgtccttgggtcagtctgttctaatgttgctataaggaaatatctgaggctgggtaattcataaagaaaagagttttaattgactcatggctctgcaggctgtgtaggaagcctggcgccagcatctactaggcttctgaagaggtctcagggagcttcgactcatggccgaaggctgagcttacacatcacatggcaacagctgaagcaataaaggggatgggaggtgcacacacttttttttttttttttttttgagatgaagtcttgctctgttgcccaggctggagtgcagtgacttgatcttggctcactgcaacctccacctcctgggttcaagtgattctcctgcctcagcctcccctgtagcttggactacaggtgtgcgccaccacgcccagctaattttttgtatttttagtagagacggggtttcaccatattggtcagactggtcttgaactcctgactttgtgatcctcccacctcagcctcccaaagtgctgggattacaggcgtgagccaatgcgcccggcccacacacttttaaataaccagatcttgcatgaactcactcatcaccaaggggatggcactaaaccattcatgaggagtacacccccatgatctcaacacctcctaccagaccccatctctataacattggggcctggtaggaagtgtttctcccaccatttcaacatgcgatttgaaggagacatactcaaactatatcagtccataaaatatatccccagcttctgaattctttttatagctttctgtagaataattttttctgcctgttctgtaacatttatccatttcttcttaattgcaaccctcaaaattattcataataaggaattattatatttgatatattctaaggtagaattattacttaaaggaaaggtacaaataaaccatagcaaaaaacaaatatgtttaaatggtagcatctctttttttgcgtctaaattttaaatttgcatttactaattaattggagcattttgtagctaatggtgatcctaactggaaaaaacatcacattacagttgttcggtttgaccatttcctacatgatccaaggtcatcttgtccaaccagccagctcttccattcatttagccaatatttattgagcattttcaatttgtgtcaaggataccaacctatctatctgcacctgtctatctatctatcactcccacacactcttcattctagaagagttatgatttggttagaaagtgttaagcctgtattggaattataacatgaacatacaatgggtcttaacctgcctgggaaggtataaaacacagaaaaccagaggggaaaccatgcaacatgttagccaatgatgtgagtgaacatatagcagatactttatatgttttatgcagatgctgcagctgaaaatatcatgagtgcctggatgatggaagtttttataaattagaaaaatgaatcaaatgtaaagagatggactttaggagaaataaataacacacatttggtttcaagaaagtgctgcatgaatggaggatgataaaaccttggaatcagaaacagcagcggtcctagctggcagtgactatgatagcaatggccttcaagaatcaccacgggaagcattgacgtggtgtgatctaatagacaagcaccaagcctattggggctgcagtagagaaagaaaagaaagatttcagccatgacaagacacctgacaaaatttgtttacaaatatatatggactaccctctggagagacctgaataaagaaaagtgttaggcaattgtctgctataacaatgggacaagtgtgggctgtggttcgttcacactgatgatgtgaactgatgatcaggaggaaggagagtattttcacactgatgatgaggaggaaggagagtataacgaagtaacagaagaggttacagagcatgtttatttgccagctaaagctaaagtggcaaaggagggagagtttcatccctacctttctgcaccccctcattgttattttgaagaaaaagagtgtcctgaccctgcagatctctcttttccagaggacattgggctaaaagtagttgccccagtgactgttcgagcagcaccttgagtgaccgctctcagttctattcaggcaggaattcagcaagctagacaagagggtgatatagaggcttgccagttccctgttagaacacacctgccagatcaacagggaaatattatagctacatttgagccttttccttttaaatttgggaaagcacatttagttgattatatcaaggcctgtgatggtattggaggtaatctgcataaggctactctgctagcacaggcaatggcaggactgagagtggataaaggaaatactccatttcctggagcttgttttaactgtaggaagcatggtcatacaaaaaaagaatgtagaaaatattagcaagtcaggccgccagataggggaaaaaagaaaactactgagcctgaaatatgtccaaaatgtaaaaaaggaaaacattggggtaatcagtgtcactctaagtttgataaagatgggaacctgatttcaggaaatgccacgaggggcccatcctgggccccattccaaaccgagggatttacggctttggccattccctcacccctgtacaatgtctgtcccccgccacagctggtagtgctgcagtagatttatactgcacaaaagctgtgagccttctgcctggggaacgccctcaaaaggtcccaagaggaatctgtggacccttgccagcggggatgataggattacttttaggaaggtctagcttaagtttaaaaggggtaaaaatacatacaggagtcattgattcagattacaacggggaaattcaaattattatatctacttctgttccctggaaagcagagccaggagagtgtatagcacagctcctgattgtgccatatatggaaacagggaaaagtgaaattaaatgaacaggaggatttggaagcacaaataaacaagacaaagcagcttattgggtaaatcgagttactgataaacatcctacctgtgaaacaactattcagggaaagaaatttaaaggtttggtagataccggagcggacatttcaatcatttctctacagcactggccgtccgcgtggccaattcaacccactcaatttaacatagttggagttggtaaagcccctgaagtatatcaaagcagttatattttgcattgtgaagggcccgatggacaacctgggactattcaaccaattataacttctgtatctataaatttatgggggagagatttattacaacaatggggagcacaagttctaattccagaacaattacatagccctcagaatcaacagatgatgcatgaaatggggttatgtccctagtatgggactaggaaaaaatttgcaaggtttgaaagaaccacttcaagcggaaagacaaagtttccaccaaagattaggatatcatttttgatggtggccattgttaagcctccagaacctatacctttaaaatggttaacagataagccaatttggatagaacagtggccactaagtaaagagaaactagaggctttagaggaattagttactgaacaattagaaaatgggcacatagctccaacattttccccttggaattctccagtttttgtaattaagaaaaaatcaggtaaatggagaatgttaactgacttaagagccatcaattcagttatacaacctatgggagcattacagccaggattgccttcttctgctataattccaaaaaattggcctttaatagtcatagatttaaaagactgtttctttattatccccttagctgagcaagcctatgaacagtttgcatttacaattcctgcagtaaacaagctgcagcctgctaagcattttcattgtttcacagatgggtctagtaacggtaaagctttttattctggtaaaaaaaaagtaaagttttccagacaccctacactttagctcaaaaagcagagattgtagctgtaattgaggtattgactgcttttgatatgcctattaatgtgatttctgattctttatacgtggtccattccacacagttaattgaaaatgctcagttactatttcatacagataaacaactgatggcaaaaacaaaaaagggggagaaataaggattataggacagcccatacataattgaatctggcattattaactttaaatttcttgagcctgcccaaaggccagatgttatcagcagctgaacagcatctacagaaaacagctgcaaagacagaagcagaacaactggtttggtggagagatccgataacaaaaagttgggaaataggtaaaataataacttgggatataggttatgcttgtattcctccaggccaaaatcaacagccaatttggataccatcaagacacctgaaaccttatcatgagccagatgccaaggaagagattccgggaggatcccgaggacccaccagttgcagccatgtcgtggctgatgctgagaaggaccccaaatgtcatgagcaacacctgtcaaatacagccacccatctggggacagatcaagaagctgttacagatggtggaaggaaacctgaggaaaccggaacaaccagtcacagtgagtaatttaatggtagctatgatagtggtgatcaccattgccatgagtattccttcaacaagggctgacacagagaacaattatatttattgggcatatttatcaatcttggctggcaataatgcctggatgtaatcactctatgacacagttacacatgctttctaatctcagtatttaccgtaacaaatctgctcccataattgaggcttaccgccctcaaaaacctatttgtaaacaaaatagaacctggccagaaataatgaacgtacttgtttgggaagattgcattgcagaacaggcagagggactgcgcaatgattcctatggaaacattattgattggtcccctgaggggatgtttagcttaaattgcacctctcagtctgtgtgccatggccacactatgttcagctgatctgaacaaaaccgtcagatggtagaaatgataagaagtatggcaaaagttcctattatctggaaccatggcggtatagtgacacctcaacctcaaatgataatggcccgttgtaggagctaaacataaggatttgtggaaactattaatagctcttaataaaaccaaaatttgggaaagaataaaaaagcatctagaaggacactttacaaacttgtttttggatattgcaaaattaaaagaacaaatatttaaagcatcccaggcacacctgaccttaatgccaggaactggagtgcttgaaggagctgcagacagattggtagctagtaacccattaaaatggataaaaacacttggaagctctgtgatttctatgatgattgtgcttttaatctgtgttgtttgtctttgtatagtctgcagatgcggatcctgactcccgtgagaagtagctcaccgtgacaaagctgcctttgcttttatcactttgcaaatcaaataagggagacatgttgggaacaggcctccccaaatgtggccataaactggccacaaaactggccataaacaaaatctctgcagcacggtgacatgttcatgatggctataacgcccacgctggaagtttgtgggtttacaggaatgaaggcaaggaacaccggcccacccagggcagaaaaccacttaaaggcgttcttaaaccacaaacaatagcatgagtgatctgtgccttaaggacatgctcctgctgtagataactagcccaacctattcctttatttcggcccatccctttgtttcccataagggatacttttagttaatctaatatctatagaagcaatgctaatgactggcttgctattaataaatacgtgggtaaatctctgttcggggctctcagctctgaaggctgtgagacccctcatttcccacttcacacctctgtatttctgtgtgtgtgtgtcttcaattcctctaatgccactgggttatggtctccctgaccgagctggtcttggcagtcttgcatatattttttcaatctgtctttcatcttttttaacataaagcatcttttgcttgttagaaaactttatattagtttgtgattctatttcctaatttttctcttgggcattgatttgatgcctagaaaagactactagcctaagattatatgaaattatttacttatattttgtttttaaaatatggtactcagttctttaatctctttgaaatatttctgtatggtgaaaaatgaggatataattttattttcttctaaatagatattctacattaccaacatgtgttatcaaaaaatttttacagtcttagttcagacttctcagaagcatattctaaaatacgaatgtctatgcaagtaatttattaacaagttacacctagtagtaagaagtagaagaagcaggaaaaggaggggaaataagccaaacaaggtaaagttcagggctcagcctgatcccacgagaagcctcagaacatacatttcactgtggagtttgttgcttgtggaggcaaagaagctgggctttcatcctctttcagcagtcagtcattggaagtgggctacctggagggaaatagaactgccagacacttgtgactcttggtgcaacagaggaagcagctccaataacctaaaagtagccctttaaagaagtttgcaagtgggtagccctttaaataactttgcaagtttggggtggggcgcggtggctcatgcctgtaatcccagcactttgggaggctgaggcaggcggatcatgaggtcaggagatcgagaccatcctggttaacacggtgaaaccccgtctctactaaaaatgcaaaaagaaaattagccggccgtggtggcggacgtctgtagtcccagctactcaggaggctgaggcaggagaatggcatgaacccgggaggcggagcttacagtgagctgaaatcgtgccaccgcactccagtctgggcaacagtgggagactctgtcaaaaaaaaaaaaaaagtttgcaagtggggactggcaggagtcaaacacaaagaaactggagattaggaacacagaatccataggagagacacatgggatccacccacagatactgacagtgtctaacaacatccatccctttcactgctcagtcccagttattgctgacgttaagtttatgccatcatgtcacagtttcttcaaaattataatggttaataatttctaggttaaaaacttctataagatgatagttaatggaacaacctataacccatgattgaagttatttccaaggtcataattatcaatacttgttttatctctcctctaccacccatacccaatactctcatctagcatttcttctggcccagatgtcttgtgtggtggttgactgactttcatccagaaaggatctgagcccatgttaatgctcttgttagatggtaattacccattcccagttaaaactgaacatgacaacaccaagagacatcccaatggatcacctgatgatctactctaggtaggagtgattcctctttactgattttaagtggctttgaccctatctcatcatgacgacaaaggtcaattacccctgtgtgacagtgattcaattctttacctgtttgtacgatattatgaggaggccagtatgaactggtggcagatagttttaagtttaacttaagcctgcctgggtttcctggtggaattatccttctgagaatgaggacctcttgacaacagagagttgaaatgatacaaaacacaaacagccccaaatggatcaatgagagtgatgagttcacagagtcattcctacttccattccttgaattttggacccacgtattctacctcctgaagacacagactgtattatataagttatactgtctgttacatatcacacttgaaggatacatatcacactaagttacatatcacactcgaaggataacatctcaagcctacagaggctcttctccaagacatcaccttagttgtatcttgaagcatctatttccatgccctgccagactggaagcttctggatggtgtgatctgtggtagtaccaagggatccaaagctatatgctcagtgtcacatatcctattcagcaagtgaattctttggtcccaaacagcgttatgaaggagttcatgtctgtaaatcagactctctctgaaccactgagtaatggtactggcaaaggcatttgggatggaaaggaaaggtaaacctgtattcagaatatattatgtccgataagcatgaatcgcctgtcttcccggggtcgaatccattcaagtaaaattgccatgaaatggcaggttcatttctttaagtcacaatactttattggggactcagtttgggtccctatctctgacacatcagaactttggcagcagtagtagctaggtcagcctagatgacagaaagcccatgctgttagcccaaaacttccatctctgcaatttggccactctgtctgtgagcccattgcataagccctggggcaagtgagcacagagactagctgacaactctagacaagttctgtcctactggttcttccatgtctgccctgaaatatggaatttgttgtgcacatccatgtcaaatacaatgattgccatgctttctacctactcccatagctctaactgcatgtcttttccacaaaggcccctggtcctgattttccaagcatcttcctttcaggactcttgcctgaattgcctgaattttaatttttcagactgtcttctcttacttaccaatttacatgtaaggtgtctctatcttttttttcatgtctcaatagttcatttctttttatcactgaataatattccattgtatttatataccagtttgtttttccattcaccaatagaaggacatcttggttacttccatatttgatgattattaataaagcctctgtaaacattctcatgtaagttttagtgtggacatagttttcagatcagttgagtaaacgcctaggagtgtgactgctggattatgagactatgtgtagctttgtaagaactgccagaacatcttccaaagtggctgtaccatttttcattcccaccagcctgaacaagaattccttttgttccatatcctcaacaggatttgatgtcatcagtattccagattttggccatttttttccaacttttattttatattcagggggtacatgtgcaggcttgttacacaggtaaattgtgtattggtatacagattatttcatcacccaggtaataagcatagtacttggtaggtagttttttgatcctcattctccccccactctctaccctcaagtaagccccagtgtccattgttcccttcttcgtgcccaagtgtactcaacatttagctcccacttgtaagtgataacatgtggcatttgttctctgttcctgcattgattcacttaattagctccatccatgttgctgcaaaggacatgatctctttcttttttatagctgtgaaatattctatggtgaatatgtaccacattttttccagtccaccattgatgggcatttaggttaattccatatgtttgctattgtgaatagtgctgcagtgaacatacatgtgcatgtgtctttatggtagaacaatttatattcctttgggcatataccgagtaatggtatttctgggttgaatgacagtttgtcttaaattcttttaggaatctccatgctgttttccacagtggttgaactaatttacatactcacccgtggtatataagcattcccttttctctgtaacctcaccaacgtctgttgttttttggctttttaataatagccattctgacaggtgtgagatggtatcttattgtggttttgatttttattgctttactgattaataatgttgagcatttcttcacatgcttgttggctgtgtgcatgtcttcttttgagaagtgtctgttcatgtcctttgcctattttttaaagtggttggtttttgtttgctactttgtttaagttccttctagattctggatactaggccttcattggatgcctattttgtatctattcccattctgtaggttgtcgtttgctctgttgatagtttcttttgctgtgaaaaagcttgttcatttaattaagtcccatttgtcaatttttggttttgtcataattgcttctggtgtcttcatcattgtattagtccattttcatattgcgataaagaactacctgagactgggtaatttataaagaaaagagattaattggctcacggttccaaaggctctacaggaagcatggctggggaggcatcaggaaacttacaatcatggcagaagcaaaggggaagcaagcacattttcacatgggggcaggagagacagaaaaggaggaggtgctacacacttttaaacagccatatctcatgagaacttgctcattatcacaagaatagcaagggggaaatctgcccccaagatccaatcacctctcactaggcccctcccccaacactgaggattacaattcaacatgagatttgggtggggacacagagctaaaccatatcaatcatgaaattattgccaggtattggtatttcctaggctttcttctagggtttttatagttttaggttttatatttaagtctttaatccatcttaaattgattttttgcatctggtgaaatgacagggtccagttttaatcttctgcgtatggttagccagttatcccaacaccatttattgaagaggaagtcctttccccattgcttctttttatcaactttgttgataatcagatggttataagtgttctttagcatgttccattggtctatgtgtcagtttttgtgccagtaccatgctgtttggattactgtagacttgtagtatagtttaaattttggtagtgtgatgtctctggctttgttctttttgcttaggactgctttggctattcagggtcctttttggttccatataaattttaaaataccttttttctaattctgtaaaaaatgtcattggtaatttgatagtagtaacattgaatctgtaaactgctttgtgcgatatagaaattttcagaacattaattcttcctatccacaaacatagaatgtttttccatttgtttgtgtcatttctgattgctttcagcagtgttttgtaattctcgttgtacagatctttcacctccctgattagctgtattcctagatattttgatgctattgtgcctattgtgaatgggattgtgctgttgatttggttctcaagttggacattgttgtatataaatgctactgatttccgtacattgattttgaatactgaaactttgctgaagttatgtataagatctgggagcttttgggcagagactatgaggttttctaggtataaaatcatattgtctgcgaaaagaggtagtttgacttcctctcttcctatttgtgtgcctttcattttttctctttcttgattgctctgtctggtgcctccatttctatgatgaataggaatggtgagagtggtcctcttgtcttgttccagttcttaaggagaatgcttctagcttttgcccattcagtattatgttggctgtgggtttgtcagagatggctgttactattttgaggtatgttttttcaacgcctagtttgttgaggtttttaacatgaagtgatgttgaattttatcaaaagtcttttctgcatctattgagaagaccacgtgatttttgtgttttgttctgtttatgtgattaataacatttgttgatttgcatatgtggaaccaactttgcatcccaggaataaagcctacttgatcatggtgggttggctttttgatgagctgctggatccaggttgctagtttttcgttgaggatttttgcatctatgttgatcagggatattggtctgtagttttctttttttgttgtgtctctgccaggttttgggatgctggcctcatagaatgcattagggaggagtccttcctcctctgtgtttttgaatagattcagtagcattggtaccagctctttataagtctggtagaattcacctgtgaatacatttgactcaaggttttttttctgagtgatagggttttttgtttgtttgttctgattcaattttagaactgattattggtctgttaaggatttaatctcttcctgattcaattttggagaatgtcgtgattccaggaatttatcaatttattccaggttttctagcttctctgcatagaagtgttcataatagtctctaaggattttttgtatttttgtcgggccagtggtaatgtcccttttgtcacttcttatttgtttatttgggccttcactcttttttctttagtagtctagctaatggtttatcaatcttatttattctttcaaaaaaacaaacttttgattttgttgatcttttgtattgtttttagcatttcaattacattcagttcagctgttattttggttatttcctttcttctactggttgtggggttggtttatctcttgtttttctagttcctctaggtctgatgttaggttggttgttgcgggaagtcagggaccccgaatggagggaccagctgaagccatggcagaggaacataaattgtgaggatttcatggacatatattagttccccaaattaatacttttataatttcttatgcctgtctttactgcaatctctgaacataaattgtgaggatttcatggacactcatcacttccccagtcaatacctttgtgatttcctatgcctgtctttactttaatctcttaatcctgtcatctttgtaagctgaggaggatgtctgtcgaaacaagaccctgtgatggttgcgtcaactgcacaaattgtttgtagagcacatgtgtttgagcaatatgaaatctaggcaccttgaaaaaagaacaggataacagcaatgttcagggaacaagagagataaccttaaactctgactgttacactattacacacagtataattacacacattgtatcacacactgtgtaattccacacactgtgaattgcacacagtatcacacacacggtgtaattgtacacactccattacaaactgtgattacacaaaatcacacagtataattgcacatgccatatcacactgtgtaattgcacacgctgcatcacacacggtgtgattacacactgtatcacacactctaattgcacacacaccatatcacacagtgtaattacaccctgtatcacacacactgtaactgcacacactgtatcacacagtgtgattgcacacacactgtatcacaattgcacacactgtataacacacatggtgtaattgcacacacttatcacacacagtgtgagctgtggggattgtttggctgctcctttctgatggctctttccagactctcagtagtttccacccacccatgctcattcagtgctaaaccaaagaccagaggagatccctctacaaatctccagacctctttccctttccagcattttgtcctgcaaattctggccactgtggctccccttgttctgaactcagtttccccaagtcagtgagctcactgggctctctttggatccctcctgtgctgcagaccagaaactctccaggaagcacacggcacttctaagccttgccgcgtttatttgccatctcttagcaatgttggccaacatctgaaatctactgttttatgcattttgcccagttttccacttgttcaaggtagaagttgaaatctggtctctgttatttcattgtagctggtgagttttttttcccaaattggcgagatgtaggtgtacacaagtacagtccatatgtatttagataatgggcaaaattaagctattagagtgacaagtgcttttatacactatttagggtatgtgtattggtatggttcctgaaacagcatatatcctggagagacatataaagagttacatttctatccagccagtaaggatgattcccgttgtttataatacagtggggaaggacaacttcatgtccaaacagaacttgtgtttaacattttttgatatttgtttataaattttgatattaaaattaaataatccattgaaaataatgtgttaaaactatgtaatgagaaggacttatgtttataataaattattaaatgaaaacataaacttccaagataccctctcttttcctctatctttctgcatttgggaaatgcggtcttagtgacttaggtgaactgcagcattaatttacaaatttgaaaaaaagatttaataattcatgaaggttatctgaaagggtaatatataataaacaacagatacgcctctgaaagagcatatgttgccactggacacacctctaaagaatacattttattgcattaatcacatttatggtgcctttattatttcattatataaatatataatctcatcaaggttcattttatatttaagaacaatccaatttttattaataaattgaataccaataggaaaataatagcatgggaaaatctaatcaatggataattgaggcctaaagcaaaattagattattttgcaagatttaatcccaaaggaaattagattctgtatcttgcttttataattctcattttaagaaattaaaaattttgtattaaaatattagaagataaatcctgtgatcattttgggtatcttattatacccattaaaaattttacttaaaaatgtataacccctcatatgctaatttgtaatgtttacgcttgtaagtatttgagtctattaacgaattttatatggctctattaatcattacaaaagatatactcaccaagccctaaaagtaagtcccaaagattaaaaaaatctagagaactataaaagatattggtttttggttccaaagaaagtcaagcaatagaattacaattcattcaaaaaactattttcattttttctctgtagttccaaggctttgtgacaattctaagaggtatcagacactatcctatttcaagtattcagtagataagggagttggtttagaatcaagcagactttgttttgaacttaaattcattttttgccttattgacttttgacttttcagtttattttcctggatttccattttctcatctataaaatggtgattctggcatatctcattgtctagtacataataagggctcagtaaagctactaacttactgaaaggaaaatatatttctaatgtcagtgccatggtgacaacagcatcatagtaaataaaaagaactaaaagctcaggtggttgtagagcttgtgtaaatgtgaggtccatgttcatcatcactgccatctagtggcagtgtgacaaaccgcactgtatactctcttcctcttataaagccaccagtcccactcctgtgacaacccactaatccattaacccattaacccataaatccatgaatggattaatccccttctgagggctctgccctcacgacccaatcacctttcaaacgccctacctttcacttctgccacgtgggggaataaatttccagatgagttttggaggcaacagataaaccatagcagtttggtgatagagaattttaatatcatagaattttatgataaaataagacaattaatgatagtatgcttaacaaaggtaaaaattactctccaaatgtgatcatcatagcaagccgaggttttgctgacaaagtaagtttcatctcctgagtaatttcataaatcaatggaaattatctttttttctgtatctagtagacatactgactattcctttgaagccaaatagtgctaggactttttcctgtgaagtggtatgagaagtaaatcctttctgtgtaacactggctatgaaaattatactatagtttttagtttatccaatgaaagaaattctctttaagagatcatttttacaaattttaatagcatattggtagtacattcctttaaacaggtcaaaatttagttctttattaagctgataataatagttgtatagcaatctttcccatagtttattaatttatgatctcgctgaacatatttgttttaaacacattatgttttggggatgtgtttagacatacaaaagggattctttttactttgttgattttccctattctaattttttcatagtcttccattaagggctcctctttgaatgattattttaaaatttaccttcctcttacattgttttccaaatcaatctttttccctttctaaaatagtacttttggggccacgcgcggtgcctcacgccgcaatcccagcactttggaagctcgaggcgggtggatcacgaggtcaggagatcgagaccatcctggctaacacagtgaaaccccgtctctactaaaaatacaaaaaaattagcccggtatggtggcgggtgcctgtggtcccacctactcgggaggctgaggcaggagaatggcgtgaacccgggaggcggagcttgcagtgagccgagatagcgccattgcactccaggctggacgacagagcgagactccgtctcaaaaaaaataaataaataaaataaaatagtacttttatttagttaaaacaaatgtcataataggaaggttatcaacacagaatagtagtatacaacaggttttgattttgtttgcatgaatcctcgtcaatattgcctctaaaacttcaaaaactaaccagttaataaacattagccgtcttcaccttagcaatttcacatgaatccgtggaaaacatatgctcctgacatattcatatatcctaaaacgcttttgtgctgtatgtctattgacaattcgtacggtattgcattttgattatgcaaaatgacatacagagtaatttattcctacgctggaaatagaaaagttacctaagccacaagccccagggtactgttagcagtgtctgttcacaataatcacaatgaatttcatgcctgtggcctattttcacattgcagtattctgggcccagagctcagacaagctgttctgctctgaggcacgcataacaactagcaacaagcatttggggcttcctattgaacatctgttgcaagagcagagagatataattacaacgcagtgccccatttctttcctcctaatccaccaagaatcatttttaatagtttttttctattatttatatggtttaagtaaattattcaaggagatgttgattgtaaaatggttcttttgttcccagcctgttttccttgggttcgttgtcaggtgacctgaggtccaatgccttcattccatctcatcagtgtccgcctttcctctctctctcttttattatttcgttactcttccacagaccttcttttcctacctataaaagtgacctcatatattattactattctcagtatcttctaaaacatgagatttttttttcatacttagcacatttacacagggtttcctttatatagattgtgcaaagccattgattggttttctctttccacttccttcttttttaaaaaaattaatctgggggaaggaatataagcttcctcccagggcagtgtatgcaggagatgctgctactcactatcttcactttaacagcctcactaatattcacaccaatatgaacgcacacacacacacatacatgcataaacaggcacacacacatctacacacacaccacacacatgcacacaccacacacgcacacaccacacacataaacacgcacaccacacacatgcacacatgcacaccacacacacgcaccacatgcacacacacaccacacatgcacacaccacaaacatgcacacacatacgcacacacgcacaatctgtctttagtcctcactcatctaaaattgttttcaaaaatgtcactcagtgtgtctttatgtaaagcgaaaaatatatattttgtacttattcatgtaatctatctttttttctgaaatgctctctttcctctgcttctaaaatgtcacgtcctcttaagttttctcgtagccattctggacaccttttctctcttaacggtgatattcctcaggatctcttcttttcacattctatgctgttgaaattcaaccagagatgaacttgagaatcacaggtgccagatgtcactacattcaaactgaatgtgaacacaaaggggcatgtccttgacaaagacatttaaagaaagccacccatgcacacctgtttcttttttgtttgtttgaggtggagtctcactctgtcacccaggctgcagtgcagtggtgtgatctgggttccctgcaacctccgcctcctgggttcgggtgattctcatgcctcagcctctggaatagcagggactacaggtgtgcaccaccacatctggctaatttttgtatttttagtagagatggggtttcactatgttggccaggctggtctcgaactcctgacctcaggtcatctgctcacctcagcctcccaaagtgctgggattacaggagtgagccactgcacccagcacccatgcacatttaagttctcatctgggaatattttccttctccgaaaagaatatgcttaatatttctcttagtgcagattatcaattttaaaaatctttttctctttcaaatgaatttttaagcacattgttgaagtaaacattgaattctacattgacattattttattttattaaatatattattccattgacttctgacttccatttatcatgttaagaagagacatttcacaacttatttcacacccactagaatgactatattaaaaaaaaataggtaacagtaagtgttgccagaaccctcatacactgatgatgacaatgtaaaattgaaccacaactttggaaaacgtttgagcagtttctccaaaagctaaacatacagttaccatggactcagtgagtttacttcttcattatttacccaagatacgtgaaaacatatgttcaccccaaaattataaacaaatattcacagcagcattattcataatagtcaaaatgtagaaacaatccaaatgcccatcaaatgatgaacggataaacaagattgaatattattcagccatacaaaggagtgaagttctgatacaatatagatgaaacttaaaacgttttgctaagtgaaagaagccagtcggagaacaccacagattatataatttcacttatatgaaatttccaaaacaggaaatgatatagacagaaagtagatgagtggctgcataggacttggggacagaaggattaggggtgacagctgaaggatatggggtataaaatgttcagaagttgtgttgatggttgcaaaactgtgtaaatatactaaaaaatcattaaattacacactttaaataggtaaatactgaaataaacatatttcagtaaaggtgttaccaaaaaaaaaagccaggtgtatgtctaaaaccttgttatagtgaaaatgtatattttcttgagtttaacattttatttttgtcttcgtttttatggttttattatcgtgtgcctacatgtgatttatatcattatttattgtatttattgtctgtagacctttttaagtccatgattggttgactttctccagttttatacaattttcagccataataacttcaaatattgctaccatccaattttatctttcacctcttttggataccttttggactttctcacaaattctagatgtaattactgtctttggtacttctctctctgtgtctctctctccatccatctctccctctctatatttatatgtagaaagatacatacatatatatacagtgtgtatatattatataatatacacatacacatatatgtatatttatacacaaatatagtcccattcttatctgtgtattaataaatggctattaaaactgtagactgagttcttaatttcagttattttatgtttcagacttaaaaactgatcttgattgtactttttagagttgacagttctctgctgagactctcagtattgtatttcacatctttgactgcaatgatcacagttatattgaagtctgtattggtttatattagaacttgaagttttatggctcctttatcatttgagtgggttctaatgtacactgtcttgtcacctatactgtttgatgcagtcctatatctggttagagctattttcctccagagaggattcctgactggggtcctagaggtacaggacctcaccagacactgggtcacgtaaagtgtggatgcagtcattgcgtggattgtgttacccctgttactcttatttgtaagcttcagctctcagcatctcaactcaaaagcctggaggttttaccaggatcctctatcattatattaatgacctctggcttccaatttcagtccctcacccagccttgggagtttgtcggagatgctacccagccttccatctgtacatttctataatccgcaatcagcaaacaaccccatagaaacagggatcccttttctgaacttctgtgtctcaaattttggtaggtaatttttcaatatatttttaggcattctgtgctttcaaagaggttttccccacctagcttttctacttttctcagcagggtgagggatgggattctaaattacctagtgcaccgtcattgaaagcagtagtctgtcctcccaactttatttcagctaaagggtaagttgtaccctttaaacaaatctttgacattttcaggtgtttatatagtatagttccacgagataagattttctccttccttctattgcctaagtgaatggtaaaaaggaaatttctttcaagtaatttgaaagcacttaaagtagatttttagctataagtaataaatgaaagtacataccttaatgtggcctgaagccccacccttcctgtggctgtccatgcctgtttttcactgaacagctcagagtgtactatgccactcttgcttcatttcacacatgggctagctgcattactggacgctgttatattctgattcaaaggaataaagaactgacaaggaggcagaagtgggaaaattatctgcctccaatgtactatccacataaaaagtgaactgcaggattttttgttgattcaaatcccaagtctctaattgggggggtgatacgatttggatttgtgttcccgcccaaatctcatgtccagttgtaatccccagtgttggaggaggggcctggtggtaggtgattagatcatgggggtggtttccctcttcctgttcttgtgatagtgactgaattctcacgagatctgattgctcaagagagtgtagtacctcccccttgtccctgtcccctctccctcctgctcctgccatgcaggacatatctgcttccccttcaccctcagccatgattttaagtttcctgaggcctcccaagctgtgcttcctgtacagcctgtggaaccatgagccaattaaacctcttttctttataagttacccagtctcaggcagttctttatagcaatgtgagaatggactaataaggggggcatacagagtgagtcgatagaggcctctctttactccctgccttgctatttgtgttgctgtctttctggtctaagacaagccagccaactatcagtcatttctgtttggtgtaaatgggtctaaatgaggcatgattctttaaagagattagaaagataatcaatttatattcccagtgttgttgcaaatctacatctcttgcctggtttcttggtgtttctgtggaaaaagtaaatctatccaagccaacaagctaaaagcatgacctgaaaatctgacctttattaattataatttttttcttcactctaacaaaaactaatgtagaatagcaaaggttgttgcaacacaattagaatatgtaattgcacactgggtcagctaaaagcaatttggtatctaattgtgattgtgcaagcatgtctcatatctactatcattaaacagtcaaatacaggcatctgtggctatctaaaccctctcaatccaaactcagtaactaaacaaatttggatcatgggaaatacacacgtacctaatccgtgtagccattgtctttcttttcagttgacctgcatgtatcaaataacaatagttcaaagaatacctgctgaatgaataagagaagagttacattatttaattaaacagctaaccaatcaaatcaatctatttatagcatttcctgaatgttgatgactttgcagaagttcattctaattaggccatttggttaccacttgcagagactacctaaaagaaatgagaaatggtgaacagatacgaggcacagctgaaggcagatacaggtaaatatgtccgtatttttggaaattctggacacacatggaagaacttacctcatttcaaagatcaaaacaaacactcgtattaaaattatgctgtggatctcaaagaaatcaataaactacacaactcgttaatttttgtaaggttttctaatactagacaaaacagtgatatgctacatccaaattcttcattttcttcatcttttttttttttttttttttttttgagacggagtctcactctgacacccaggctggagtgcagtggtacgatcttggctcactgcaacctctgcctcccaggttcaagcaattctcctgcctcagcctcccaagtaactgggattacaggtgcccaccaccatgcctggcttatttttttgtattttttgtggagacggggtttcaccatgttggccaggctggtctcgaacttctgacctcaagtgatccacttgcctcagcctcccaaagtgctgggattacaggcctgagccaccatgcccaggcttcttcatctcttgatgtgagcaagagctgaaaatactggacaggaatactggacagtaaaatagacattaataaaaatccataaaaaaattaatccaaaaaaattaataaaaatttgcaaaactgcaacaagctttcattcgaatattagatattataagttgatcaaaacactaaactcaatgtctttttagctttttttctaacaaaatattctattatctaaacatattatttctgaccaaaaattcagtgtggataggactgaatgtgtgaaggtttagtgctccaaatacaagctccaggataattaaaatagcaaagaatcatttgtttttaatttattatcctttcagggatagttggtctatttcaagaataaagtcatttaatatcaccaggagaaaaagaagtgggttgggtgctggaatgtgccttcaggcaaagattgctattatagatttaactataggactgtgtttaattaaactttattactttatttgctttctatcatatgaagggaaataatttgcattatattgttagccatttaaagattatctgttttgaccaaacacacattgtgtatgtaagtgacacctcctcggttcagccctgcctggagttgtgcaaagacctaaaattaggttcaaattcgagaagttctgaaactctttggctactaaggtaagctctggaaaaattaagggtcagcgagcagcgagacagaagtcagaatttgaaaaccagattagaaccagagaaatatctcagtcaaaacatgagcacagagaatgcaacactcggtccaatttaacgaggttccagatcaccaggctttcattctcatttagtcaaccatgccaaagctccggccctagaaggactaaaaggcactgcaatagtttgaatatttgtcccctccaaatctcatgttgaaatttaatccctgttggaggtgggacctaatgcagggggtggggagggcaggcgtttggatcatggggtgagtcccaatgaatagattattacaggggagggtgagtgagttcttgctctattagtaccaacaacagctggttattaaaaagagcctggcacctccatgctctgtctggcttcctctaaccaagtgatctctacaggctggctccccttcaccccatgccatgagtggaagcaggctgcagccctccctggaagcagatgctggcgccatgcttcttgtgcagcctgcagaactgtgagccaaataaccctcttttctttataaattacccaacctcagttattactttatggcaacacgaatggactaagacaggcacttagcagcttctgacaaagacaggattctagtgcacgaggagaaaccaagagaaaatcagtactgaaaggagaaatccaaatacataaaaagacacttgccccaggagatggcttattaactgtggtgaagaccagaaaagatgagccacagattggagaaagatatctgcaaggcaagaccaatacaggaatattatacagaatacatatatgttttattaacctcatacaaatgggggcaaggaaaagacaaactagccaatgttgtatcagccaatatactttcaagggatacagtgggcatccacagaacttgaaaactatactgccaacaaacagattttaaaaattgttcaaactctcttataatcaaatccaaaagatattattttatagtcatctgattgaaaaaaacaagtttgatgtaccaaatgtagataagaacgtgtgggaacagcaattgtattattctggtgagaatgtaaattcatacctctactttggaaaacaatttagtaatagccatgaaattaaagatgagactatccaacaatccaacaattgcaggtctagagatgaccacacattcatatggagaacatgctggggtgttcattacagaacttgctgtgaggcaggaagaaaagggagactgtaataattgtccctcagttgggaactgggcaagggcacaatagcattcatacaatggagaccagtgaagttgctgaaacgaaaagtccagagaacatgctttttttttttttcttttttttctttttttttttttttttgagatggagtctctctgtgtcacccaggctggagtgcaggggcgcaatctcggctcactgcaacctatgcctcctgggttcaagagattctctacctcagccctcccaagtagctgagattacaggcacgtgccaccacgcccagctaatttttgtatttttagtagagatggggtttcaccatgttggccaggatggtattgatctcttgacctcataatccacctgccttggcctcccaaagtgccgggataacaggcgtgaaccaccacacccagccagaacatgcatttttaaaaatgtgaagaaagtgtactaagactagtcacatacatttaaaaagcaatttctcttttgagtacatacatagacgacatttttttttatacatagtagtttacttcatgtctagagttgtgtgagctggtgacaaacaactctgtgagtaactgcctactaaggaatggaaagaaagggatccaatggggctggttggggtggttcatgcctgtaatcccagcactttgggaggccaaggcaggtggatcacttgaggtcaggagtttgagaccagcctggccaacgtggcgaaaccccgtctctactaaaaatacaaaaattagctggctgtggtggtgtgtgcctgttaagatcagctacttgggagactgaggtagagaatcccttgaacttgggagacagaggttgcagtgagctgagatcgcgccactgcactccagcctgggtgacagagtgagactccatctcaaagaaaaaaaaaaaagaaaaaaggaaaagaaagggatctgatgggaatgtggagttaaactgcatatgtaaatctttattttcttaaattgaagcaaaataattaaaacatttgtaaaaatatgataaatgttaaaccagatttgtcaaatctggttgatgtgacatttgtctgatatataatgttattttcatttgaaatattacatattatacagttacaaatttaaattatttaataaagaaaaattactacagtgctttatttcctcaataaaagcctatgaggcggaacagttaataatggttcaaataacttaaggaggcattttatttaaggaagaacttcttaaaagtgagatttccaaaacagtcattatttagacgggaccaatgctattttactaggtttatcaaagatgaggctgtctacaaacttatgtatcattctaataaatattttaatacagaatgttctaaattttaataggaaaataatatttaagttccttccatgtgccatgcataatcttatatcaagtataatttcatttttatataatttctgtgccttacctcttgcttctccccaattcacaaatgaagaaagtagttacaccgcccttcgttcatgtacaaggggagggtttgaatccaggtctctaggaacccaaaagtcatgcaccttccaaggcaaaggagattaccatgttacagcatagataaaaacataatagaattaggaattggataagtatagagggttcaatagtgttcccccaaaattcctctcaacactgaagctcagaatgtgaccttatttggagataggatctccaaaggtaatgcagatgtaatcagttaagatgaggtcataccggattaatttgggtcctaaatctaatgactggtatccttttaagaagaagagaaaacacaggacacagacacaaggaagcagcaaacgtgaagacagaggctgggggtgtagtgatgcagctataaggcatggggccaccggaggctgggaagggataaggagggacccttccccaaagccttcagagggagcagctgacactttgaatttggacttctagcctcgagaacagtgagaacatatttctgtggtttgaagccatgcattctgtagtactctgttgtagcagccctaggaaactaatacagggatacagctgagaccccaaatgtattgagatcatatttaattttcacagacattttgcttagttccatcttgctttccttcagcttagagatgaaaaaaacatagtccctaccttcatgcatgtacaagggggaggatttgaatccaggtctctaggaattccagattcctgcaggttccaaggcaaaatagttcaccgtgttatgatatgtgtgtaaatgcaagataacaaagaattagataagcaatttaaaatagtcatcctaataattcctaatgaataataatgatgaaagctgttagtgaaatccataaatgttttatttagatggcttagatccattctacaacaatctttattttcaaaaaataaattaagcaacaaaaatttactaatttcatattttctgccatcaccataaaacagaatcaatctcatgtggttatattttgggcatgtagcacataaatcatgtcctctattactaagatgctcctatttgacttgtagaagtttgtggatcatttaaaattgaataaatggtttggtttgctttcagaactataaagagtataaactggtatttggcaaattgtttttttcaaaacacagaaatctgccgttttaagtttttgttcagatttcaaaattaacttcttattggacagaaccagtttaattatgttctgattttctctcttctcctttcaagagccatagtttattatgaattcggaaagcttaagtttctattacccctttaaatgaattggaactaattggtcaatagttcttggcaataatgagttgcaactagcattactttcctagtgaattatacaaatgcactatcttgactgtgaaactccattagagttgcgatcagactgcagtggctttcaccaataatgtctcaatggcacttaattgaggggcagagaaaagccaagggctgcccttattagaaaatcctgattggcatcaaaaaggcacaatagtatatttgttaagtactttggaattagctatacctggtacaaatacggtactttcccttattttccacactggtcaggtctgtgcaagcctactcccagaagtccaaggaagctgagagttcgaaggaggaggctgacaaatctagtctcttagaaataaacatttaataaggacttacaaacagacatcatgtctgtgtcttggacagtcacgggacaagatggtggatccccgcaccattacccttcagacccagggcttatataccgcagggaaagtgtgtacatgcttcccaagggaggcttaggtcaattgaagtacggtaacatcaagggattacaccttgggaattatggtaaataaatttaggctttatagtaagtccctgctcttacacaaggaacacaaggaacaatagataaactggaaatcctagagaccctcccggaatgggttagtcagaagccatcatggcagattagcatccaagatggggtttctatggcgtctacaccttacaagctataagacctaggaaagggaggcaacaccctctctaagcctaattccccctctgtgtattgggttcataaaagtacctaccaacgacttaccaatgacaaggaaggtggagtaatcggcccagaatggaaggctagtttatttttatcactgacgttgtttagaaatgctggtgtatgcaataataacaagcagaatgaccgttgttgtttttcatttctccatggccatgcactcacttctttactgttcccaccactccactctaggctggcaactaggactcacttcctagtgttactacagggatgaaatgggcagtcctggtgacactgtcctggagtcactgccaagggcagaggtagaacattgtatttaacaagattcctgggaaaggtgagatcagacaggcaggactgcttgtcaggagcaggaaactggtacctaggcagcacttcccaggacctgctcatggccacgggacatgatgacatgatgtgacagaagcactgactttggagcaagtgaggtgcagtcagcacacgggtggaagcctgtgtgacatctcgtagcacccagaagtttacattccatgcccccacgaaatgttcaggtcttgtggaatattttcatagaaatcaataaatggatatagtctgtgactatggacaaagggcaggaccaagagggccggcaggagaagagaagaaaggaagcataaggaattaggccagataattggtttaaatgttgctactaccaagatactctctgacgaggaagattaaataatgtaaacaataataacttaacataaaggcagacttaaaatctagataatatcaacaaagataacatgagcggggagaagagtggatgccgtcacattcgtcttcttttttcccacagggaatttctagcccagcgctaagagagacagacagagagagaaatgtatgtgtgtacacataaatatctgaaaataacaaagaaactccgggaataaaaaccagaatgatcagctttcaaaaaaccaaggaaaagaatgagaaaggaaatgtagtatgtgaataaatagacataaaaaacaaagtacagaacaaggtgagagaagattcatgaggaacagccagttgtcatgctaaagtaattactaagataagacacaatttaagaatcatatccctgaggggaaaaagagtatcaactttgtctatcactccatttctagcttggggaacagagtgcccgaagccagtgcccagtgattcctgaattggatgtaaataaaaagccaaaccctaaagacatttcctatgatttttatacatggacgttgaggctggatttgctagtattttgtgaagtttagcgcatctatgagaggcaagattgaactagaatttttctttcttgttttaccattttcagcttttggcatcaatgttagaatagtcttataaaataatgtgagaaagcactgcctccttttccattctctcaaaaagtctatataagaatgtaagtattgggccgggcacagtggctcatgcctgtaatcctagcactttgggagaccaaggcaggtggatcacctgaggtcaggaggtcgagacaagcctgacaaatatggtgaaaccccgtctctactacaaaaattaggcagatgtggtggtgggagcctgtaatcccagctacttgggagagtgaggcaggagaatcacttgaacctgggaggtggagattgcagtaagccaagatagcgccactgcactccagcctgggggacagagggagactccatctcaaaaaaaaaaaaaaaaaagtacttgttctttgaatgattagtagaattctctagtaaaataatgggggattgtgttgttggtatgaatagatttttaagtaaacactcagtttatttaattactataggtctttctatgtaggtttttgattgccttttaaatcaattttttcctttatatttttctaggaaattgtctattttatctaacttgtaaacatattagtcattaacttattcataagtagtctctcagagttttatctctgctgtacctgaagttatgtttcctttttcatattcaatattatttatttgtgctttttctattttcttcctatgcaatcttgccaagagttcacacttcttatctggcaaagaaccaagttctggttttgctaattttctgtaattaattctttgagttcatttcattaatttctgcttgtacttgtattacttcatttcttctactttattcttccctagtttcttaaactgcacacttagcctcttcattggcagttatttcctcttttataagcatttaaaactataaatttcccttgaaatactcttctccaacatttgtttaataagatgggtaagatgtgtgaaaagatactttagtacagattttctaatttctatttttttaaagattacaaataggattttgctgtcttattttctcatttctaacttaatagcactattgtaagagaacatgattagattgacactacttcttagaaatgcttagaaactttcttttcttgtggctagtcatggtggctgacatctgtaatcccagcactttgggaggccaaggcgtgcggatcacttgaggccaggagttctagaccagcctggccaacatggagaaactgtgtgtctctattaaaaacagaaaaattagctgagtgtgctggtgagcacctgtagtcccagctactccggaggctgaggcatgaggatcgcttgaactccaggaggcggaggttgcagtgagccgacatcacaccactgcactccagcctgagtgacagagcgagaccttgtctcaaaacaaaaaaacaaggaagtggctaaatttcctaagcgttaatgcacatttgaaaaagtgcatattttccaattattagttgaaaggttttatatactttcattaggtcaatcaaagcacattagttttgctgttcaaatttttttggtctcttcataaattaattacttaaagagataattaattcaatagatgtgttaacatcttccactacatgtatttatagctctttttaagtctctcaattttcactttctgtatttaaagctatgttattgggttacaagttgagaattattataactttttctgaattatacttttacaaattattaatgaccttcatacataatattactttttagtgtctatttcatatatttcttttttaaaatatctgtcatattttattttataacataaaagtaattgacttttactatttaaaaagtattttagtaaaaaattatttttatcttagaaatgcctttgagcaaaataaaaattatattccaacactcagaaattagactttaatgtatattattccatatctttttctattcatacatataataaatatatacacatttataaaatgtacatatactacatgtaatttatacatatgttatatatgtattatgtataattttttaaacaaaatgagattataccatatgtagcattttgcacctgccttttttcatttgagaaccttaccaggaagaaacttgaatataatcaaaaaaagataagacatttcaggagattagtagcccagtgagacagcatatgataatgccgcatcagtggtatagaaaataagcttcatttctttgccctatagacctgattgaaagtttcagtttcagcaaactacctatggcataggttaaaatgggaaggcttcagggtaaaggaaggaagtgtaaactgaggaagggtctgcacctgtaaggaaggaagacatgtaggaagacaagctatatgaagggagcacagtgtagaaaatgatgaccaaaaacaatctgggctgaggttgtaaaaccataaacacataaattttgttagattggaaggcttctgtaaaggaagagttataaagcgacacattatattgggaccacatttgagagctccaaattaataacaaaagagctcatacctgatccttcaggcacatggtttggaaaaagaaacaaaataataaaagtgtaagttttattgtttacatcttaaaatgttggagatgtttagctaaaagcataatagttttaggttccctgtgtatccttcctcccctatcccacacccctccagatttaacaattttgcaattgtaacaagtgtaatcctccttctgttgaattccattagcatttcaggggatactttctttatttcaaattcatcatcagttggtgatcttcacacttagactccattctttgccctgtagatttgatgcctggaaattaactgtctagaaagcacagaggtgctaatggcagtttattatgggaaaactctaaattctgtgaagtgaaaactgctttaaaggagtgaatattctttctcttatattcctttttgtgagtccaattgttgtatatcagacactttaaagtaagtaataccagaaggaaagttaaaagcagtccacacttcattcaaacacagattgtgatttgcacaagatttacagatgaattaacttgtcttaaatgactcactattccactcccaccagtgctcaattattttttggtataataaatacagcccacaatagaggattcagaagcacaaatccaccctgagcagttgctgacttaaataaaataaaataaaataaaataaaataaaataaaataaaataaaacagtgacatccgcagaatgaagaaaaattatttttagatgattccattgttgtagaagaaagcactacaggatgacagacagctatttagaaacctatttaatgcctttctaagatatcctgagatggcagagtaagctcaaattattttgtgaagattcacaaaggtttatggaagtggctgatagcaccagcagtaggcaaggtgataaccacagagttgggggtctctgttcccactgacaccatggcagttcataccctggaaaagggctcatcagagctcatgtgtactggacacttatcccatgccaggctccatagtatagagtttgtgaacctatctttttttaatccttaccagaaccctattaagccagaccttgtgatcactttaagaggaagctgaagcagagaagaagttaagaggcctcaagataacccagaaagcaacggagctagaagttggaccagttattttagttaccaaagtacatgaccttaacctctctcccactgtaaagcaaaactctgttactgttgcagtcttgccaatgcaccacaatgtttcagtcttgttgtctgaggtggtacctggagttcttggtctcaccaccaagaaaattaaggagcgtggacacaaggttgaggttggagcaaaagtttaatcagaaaaagaaagctcttcacagcagagagggctgccaactacaaggctgagtctggggttttatgggctagaaggggaggaatgtgctgactggtttgtaggccatcttggagaaaccatcacttagagaaaggtatgatagtgtaaagatccaattggaggtagaggtgaaggcttggtttgggaccttggcccacgccatcagggctaaagtgatgattcaccctatgtaaatgaagacttagcccatggctaattacagaaaggtaggcatatgtaaaataggtgaaaagtcagagaccagtaggtgaaaagtaagagactaaggcaacccaaggagagaaaaatgtgtccaaaaaaggagtggaatttgttcatacgggttcacagagaagtatttccctccaaggacatgggctgtttcttatctgaggcctgcagtttgattttcagggtgttctttgtataaaagagttttaccaaggacccaccctaactgcctgcatggccagtttcttactttgtcctctctcactatttcctgatatattatatgcattcacttacttagattatctctcttttacctcaaaaactaaatgtatcataccaagatagcagttttgtttcaaataacttgctcgtagtattaactaaaaaaaatcattctgcaagaaatctttccaggcagtgaggctgtcaaagaactctattttcactcaagccaaacatgagtctaagttttggtcagcatccaaattgctgacacttcaatctagaaacatctgttccagctgctaatgaagctaatagtgatacatgaattaaaagtgaaatagattttttaaaagtgctgtgacatactttcagtaagatattcaattaatttcttatttaattgaaaaactacgatacatttcccaatcaaaatacagcaaattaattcaactttattttcttgtcaaatgatctttgcatttatttcacatttttctgttttatgcatctgttagtcctgcgttacacatatatctaaaatcaaggagcatatcttaaccttttttcaaaactcatccatgacttcctagttaatcttttatttcccctaaactcaaaaaccactatgcttatttctttttcttttaagtgttgagaagctgtcacttgcctaggggcaaatatcttcttatagttactatttaatgaccctaaaataagatttgttaaaagttatcacgattgacgtttttcaattggacataaataaaattattctttaaagtgacaaaacttctctaaaatcagaggatccaccacaatattttccatagcagctgtgtcacttttcatttccaccaacagtgcaccaagtttctattctctccacatccccaccaacactctttttttataatagctatcctaacgggtgtgaggtaatatctcattgtggttttagtttttatttgcatatccataatgatcagtgacattgagcatcttcccatatgtttgttggctatttgtatatgatctttggagtaatgtctattcaagtcttttgcacatttttaaatagggttatttggttttgctattcattgtagaggggttttacatatatacatacattctggatattaatcccttattagatatatgactccaaatattttctcccattccataggtgtccttttcactctgttgactgtgatctttgacgatcacaagttttttaagtttgaagtaatataatttgcctatttttacttttgttggtaatgcttttggtgtcatatccacgacatccttgccaaatccaacgtcattaagacttttcctgtgttttcttctaacagttttgtagtttcaggtcttatgcttaggcttttgattgattttgaattaatttttatatacaatctaagtaagggtctaacgtcattcttttacatgttgtcaaccagttttcccaatatcatttgttgaaaaaaaaattgccattatatggtcttgacacccctgtcaaaaaacatttgaccgtatatgcaagggtatattttggagattttatagtatgccattgatctatatgtctgtctttatgccagttccacattgttttgactgttgtagcattgtaataagctctgaaatcaaggagtataagatttacaacatggtacttttttttaagaatgctttggctggccaggtgcagtggctcacacttgtaatcctagcactttgggaggccaaggcaggtgggacacaaggtcaggagatcgagaccagactggccaacatggtgaaaccccgtctctactaaaaatacaaaaattagccagatgtggtggcatgtgcctgtgatcccagctacttgggaggctgaggcaggagaatcgcttgaacccaagaggcagaggttgcagtgagtcgagattgtgccactgcactccagcctgggcaacagagtgagactccatctcaaaaaaaaaaaaaaaaagaatgctttggctacttggggttgcttgagattccatgcaaattttaagatgcagtattctataccagtgggattttgataggcattgcattaactctataggtcactgagatagtattgatattttaacaatattaactcttccaatccatgactatagaatgtctttccatttatttgtgtgttccttaatttttttagcaatgtttcttagttttcagtgtaagtttttctgccgccttggttaagtttattcctaataaacttaattttacattttatgttttgtatttttgatgctactgtagattgaatggtttccttaatttcttttttcaatggttcttgttagggtatataaatgcatctgttttttgagtgttgattttgtatcctacaaatgtgctgaattcatttattcgttctaacaatttgggtttcttttagtgaaatccctaggttttctacatataagatcttgtcgtctatgaattatcttagagataattttacttcctcctttcaaatgtagatgctttttttttctttgcctaattactctggctaggacttcaagtaccaagtttaatagaagtgataaaagcattcttgttgtgttcgtgatcttagaagaaaaacttttaggttttcatcattgaatataacgttagctgtgagctttcatacatgatcttcattatattgaggaggtttcatcctactcctagtttattaagtgttttattatgaaatggtgtagaattgtgtcaaatgctttttctgcatcaattaagatgatcaattgactgtttttcttatattgaatcattcttaaattcccagaataaatcccacctaatcacagcgtaccatctttttaatgtgctgttgaattcaactagtttgccaatactttgttgaagtattttgcatcaaaaatacttttcttatagtgtctttgtctggttttgatatcagtgtaatgctggcctcactgaatgagtttggaagttttccctcctcttaaattatttaggaagaatttaaaattggtgttcttttctaaatgtttggtagaattcaccactaaagccatctggtcctgaacttttctttgttggaagttttgattaccgattcaatccacttaccaagtataggtctgttcagattttttatttctttatgattgtcttgatggagtgtgtttttaggtacttgtctgttttatctaggttatcaaatttgttggcatacaattgttcatagtattctcttataatcctttttatttctgtaaaatttattgtgttctcctctcttctatttttgattttatttatttgaatcttctcttatttctttttttttagacagagtcttgctctgtcacccaagctggagtgcaatggcgcaatcttggctcactgcaagctctgcctcccgggttcatgccattctcctgcctcagcctcccaagaagctgggactacaggtgcccgccaccatgcccggctaattttttgtatttttagtagagacagagtttcaccatgttagccaggatggcctcgatctcctgacctcatgatccgctggccttggcctcccaaagtactggaattacaggcctggccaaatcttctcttatttcttaatctaacaaaaagtttgtcaattttgttgattctttttaagaactgacttggttgtattaattttctctactgtttttctattctcaatttcatttatctctaatttttattatttccgtcctattctagctttgggtttcatttttttcttctttttaaattctttaataaataaagttaggctgttgttttgagatcatccttctcttttaatgtaagcatttaaagctataaatttaaaggaaatttataggcgggattattacttgagccaaagggctcgaggctatagtatgcttcagccacacctgtgaatagccactactgaagtctagcctgggcaagatagtgagaccctgtctctgaaaaacattttaaaaaatcaaaaataaatgtttataaagatacaatacaaaaaaacaattaacaaaatagcagtaataagtccttccctagcagtaattactttatagatggattaaactccctaatcaaaagacataatttggctaaatggatttttaaaaattcaaggatatgctgtctacaggagatgcactttagaaacaataacacgcataagctgaaagtgagaatttaaaaaatcctaaacttctagttttctaaaaaaaaaaaaaaaaaaaaaaaaattgaaagatggggtctcaatttgttgcctaggctggagtgcaataacatgatcgtagctcactggtgccttaaattcctgggctcatgggatcctcttgcctcaacctcctgagtagcagggactataggcatgcactgccattcccagctagtttttaaatttttttatggaaatggtatctcatcattttgcccaggttggtctgaaactccgggactcaagtgatccttcctctttggcctcccatagtgctacgattacaggcatgagccacctctcccagcctcctctagttttaagagatgctaatgcctctaaagattatttgacaacatcattgtgaagaaactagtaatgtaattcaaattaaaatacaagatgtaatattccaaacgaacactctaaagatagatgatgagataaataagataagatgctgaaccaacaaaaatatagacttcaataagtaaatgaagattcttcagatttatttcaaacgacaattcctatagcagatacttatcatgtatttattggataaatacttatatttatgtatgactctgtatttttcccatgtatattatctttatttttcaagcattttaaccgtgtttttacatcttttctctcattttatcttcctctcagccctatgaagaatcaggatatttattatcatcaccaattagcccaggaaacatttacgtatcagttgattatgttcaactactcatatgtctagaaattcatctgacaaatatttaatctggcatcctttattgctctcttattattgaatggaactgaatcttatttattgtagctttatggtgagattcaaatttatttgtcatacgtagtccttatactcatctgtatagttatcactaattagcaataataagtctataagattaaaccatccaagagatacagttgacccttgaatcttgaacagtgcagaggttagtggcattaactccccacacaataaaaaatatccgtgtaaaacttttgattcccccaaaacttaacattactgataatgtaaacagtcaatgaacacatatttttatgttatatgtattatatactatattgctacaataaagtaagctggagaaaagaaaatgaattaagaaaatcataaggaggagaaaatatattcactattcattaagtcaaagtgaatcatcataaaggccatcatgcttgttgtctgcactgagtaggctgaggaggagcagaaagaggaggagttgaagttgctgtctcaggtgtggaagaactggaagaaaatttgcatatatgtggacccaggcacttcaaatccatgctatgcatgagtcaactgtatttctatagcctggtaccacaataggcatgcagaaagcagtggtaacaagataaacattggcctcacctaatatgaactttcagtatagcgaagaacacaattctcaaactacacacacatatatatatatagtgaaaaagtattacaagtgttgtgtgaacctgtaacacatcaattctagatttcataaaggaactgacagcaaataatttttagctgaaactggtcaggtgaatagaagctagccaagggaagagtaaaaagaaggacggcaggttgcggagcattctaggaaaagggaggtgtatattaggcagttctttcattgttataaagaaatacctgcgactgggtaatttataaagaaaagaagaggtttacttggctcatggttcttcagcctgtaccagaaggatagcactagcatctaagggaggcctcaggaagcttacaatcatgcaggaagataaagggtgaacaggtgggaactggagcaagagagagtgggaggtgccacacacttttaagcaactagacctagatctcacatgagctcactcaacaccaagaggatggtgtgaggccattcatgagagatccactccaatgatccaaacagctcccaccaagccccacgtgcaacagtgagtattacatttcaatatgaggcttggcagggacacagatccaaatcataccaagagggaaaagtttggaataactaaacatacagcgtagccagaagaataggttgaggagaagagtgcattcagaaaggctggagaggaggcagaggcagctcccaagaagggcttgtgaagcatgttaagaaacacggatttcaaaggaaatggaaagcctttgaaaggcaacagtgaaatcataggatcgggttttcattttcatgagcatttcggctcactgtggctgatcaatggaaaagaaagtcaagaagaccagtgcttaagcatgtgtatttttaaagtggtacgactttagcttccagttgctcgactgcttcatttgttattctcatgaagtttaccaggtcacttgaaccttgttaagtcccagttttctcagctacaaattatggatgactgtaatgtttacctcagaagacatttccaagatcacacgaattaatacaaagaacttactagccggccatggtggctcacgcctgtaatcccagcactttgggaggctgaggcgggtggatcagaagatcaggagatggagaccatcctcgctaacatggagaaaccctgtctctactaaaaatacaaaaaaaattagccggcatggtggcgggcgcctgtagtcccagctactcgggaggctgaggcaggagaatggcgtgaacccgggagacagagcttgcagtgagccaagattgcaccactgcactccagcctgggccacagtgggagactctgtttcagaaaaaaaaaaaaaaaaagaaagaaattaaggcaggaatcaaaaaattatttgaaacaaatgaaaatagagacaaaatgatatggtttcgaatgtgtgtccccttaagatctcatggtgaaatgtaatccccagtgttggaaatggggcttagtgggaggtgttgatcataggggtgggttcctcatgattggcttggcaccatccctttggtgatgagtgagttctcattcagttagttcatgcatgagctggttgtgtaaaggagccagaaacctctcccttctcttgctcctgttctcactatgtgagtccttggctccctttcaccttccatcaggactgaaagcttcctgaggccctcaccagaagcagatgccagcacagcctgtggaaccatgagcctaacaaacttttttcgttataaatcactcaatctcaggtattcccttatagaaataccaaatggactaacagatacaacataccaaaacctctgagatgtagcaaaagcagtgttaagaggaaaatttacaatgctaaatgcccacatgaataagatagatagatctcaaattaacaacctaaacttgcacctaaaggaactaaaaagaaaagaaataactaaaatcagcagaattaagtgaaattgtgacctacaaaaccatacaaaggatcaacaacatgaaaagttggttatttgcaaggataaacaagattgatagatcactagctagattaacaaagaaaaaagagagaaggaacaaataagcacaatgggaaatttaaaagatgacatcacaactgatcccacagagatacaaaaattcccagagattgctgtaagtatatacctacatacaaactagaaattctagagaaaaaggttaaattcctggaaacacacaacctactaagactgaaaaaggaaaaaacagaaatcctgaacagactgatagtgagtaatgaaattgaatcagtactaaaaagtctaccatccacaaaaagccctagactagatacagctgaattctaccagatgtacaaagaagggctactaccaatcctactgaaactattcaaaaaaattgaggtgtgactcctccctaactctgtttttttgttttgttttgttttattttgagatggagtttcactcttgtcgcccaggctggagtgcaatggtgtgatctcagctcactgcaacctccgcctcctgggttcaagcgattctcccacctcagccccccaagtagctgggattacaggtgcccaccaacacacctggctaatttttgtattttttagtagagacgggatttcatcacattggccaggctggtcttgaacccctgacctcaggtgacccacccgcctcggcctcccaaagtgctgtgattacaggcatgagccaacgcacctggcctactcctccctaactctgaatgaaaccagtatcatcctgataccaaaatatgacaaggacataacaaaaaagaaaagtacaagtctacattcctgatgatagatgcaaaaatcctcaataaattactagcgaaccaaatccagcaacatatcaaaattttttttttctttttttgagacggagtctcgctctgtcacccaggctggagtgcagtgacgcaatctcagctcactgcaagctctgcctcccaggttcacgccattctcttgccttagcctcctgagtagctgggactacaagtgcccgccaccatgtccagctcattttttttttgtatttttagtagagacgtggtttcaccatgttagccatgatggtctccatctcctgacatcgtgatccgcctgcctcagcctcccaaagtgctgggattacaggcatgagccaccacacctggccaaaaatttaattcatcatgatcaagtgttctttattcacacaataaaaggatggttcaacatatagaaatcaataaatgtgattcaccacagaaacacaattaaaaacaaaaaccataggatgatctcaatagatgcaggaaaagtatttgataaaatctaacatccctttatgataaaaaaccctcaagaaactaggcattgaagaaacacctcagaataataagagccatctatgacaaacccacagccaacatcatattgaacaggcaaaagtaagaagcattttccccaagaactgcaatatgaaaaagatgtctactcttaacattcccattcaagttagtattggaagtcctagcaagagtaatcaagcaagacaaaaaaaaggcatccgattagaaaaatgggaagccaaattatctctctttgctgatatgattctatacataggaaaccctaaagattttgccaaaagactcctattacctgataaacgacttcagcaaaatctcaggatagaaaaatcaataacatttctacacaccaataatgtccaagctgagtaccaaatgaagaatgtgatcccctttaaaatgcccaccaaaaaaaataataaaatacttaagcatacatctaaccaaggaagtaaaagatctctataagaagatccataaaatgctgttgaaagaaatcatagatgacaccatcaaatggaaaagcattccatgctcatggattggaagaatcaatattgttaagatgactttactttccacaacaatctacacattcaacattgtttctatcaaattgccaacatcatttttcacagaattagaaacatattttctaaaattaatatggaaccagaaaagagcccaaatagccaaggcactcctaagcaaaaagaataaagcaggaggcatcatattatctaagttcaaactattctacaaggctactgtaaccaaaatagcagagcactagtacaaaaatagatacatagatgaatggaacagaatagagacccatgaaataaagccacacacctacaaccaattatattcaacaaagtcaacaaaaataagcaatggaagaaaaaatactctgtccaaaaaatggtgcttgtaaaactggctaagtataagcaaaagaatgaaactggacccttacctctcacactatacaaaaaataagatggattaaagacttaaatttgagagttcaaactataaaaatcctaaaagaacacctaggaaatacttctagacactggcctagacacataatttacaactaagttctcaaaagcaaatgcaacaccaacaaaaattgacaagtgggatctaattaaagagattctacgcaacaaaagaaactatcaacagagtaaacaatatacagaaagaggttggaatatttgcaaactatgcatccaacaaatgactaatatccagaatctatacagaacttaagttaaaaaaaaaaactcaaataacaaagaaattgttctaccaaaaagacacccatactcttatgttcattgcagcacgatttataagagcaaagacacggaatcaatgcgggtgcccgtcaatggtggattttttaagtcaatatgtggcaggccaggactcactaacaactgtttcagtactgactgagtgactaagttaaatattaaaagccagcgcccttacacaaaggctgggatgtaacaaaagcccatcgaaagttttgcctaggcctttcctgggcctcaaagcatgacaaaataacaaggaattcttaacagggcacatttaggattcaataagttttattgtgggtctgaagaaactccccaggcctccacaaacaagtttattgggtgtccaaaggaactcctcaaacctctgtgatttcgcaggagacaagataagggtaatcactcaagcacctggagccatttagattaagtaaatttactgaagctctagaggaaggtcttcagaactcagatcttagttatagatcaaaagaggttaatcacatgtctttagatgaatgcacacttacacatagacatttagcttagaaggtatataaactctggaaaactttgtaatttcgagtgggtctggcgataatttccaggccttctccctgtaactgattacagaaataaaaactctcttcctccccagttcatctgcatctcattattgggccgagaaatagcagcccgaccctcagtttggcccaggaacaagtatagtggcaattccaaaaaacaggaagagaaacaaatatagtgcttaatactccaagtttcttttagattaaaacaccttgaagaagtttcaatcttggctataactggatataattggaggagttttcttagtgacatataatacaatagtaccaggtcattaaactcacacaaacacaaaaataaatggcgtttctaactggtagtacatgctcttaagcatttaggagaacttctttaagctatacaaatatagtaatattaaccacagctccgtcgttctgattctcgtgcaaaaaatgtaattttaatatttattatatgaataattatctgattcattgatatagattttgaaacttgcctacattaaaagaaatatagataatttgaggaataaaatggagcttttcaagttaacaaaagagtgaagtagagatgataaggtgatttttctgattcgcctgctaaactcttagcatctctacatgcagtgtcattaagggctggaaagatgtgtgcgagtttgttaaaggccatcagtgttgcttttgaaacgcattgtcacaccagtgtcatgcatacatcagacatcagaattcaaccaaatactatggcctagaggccaaatttaacattcaagaaggacacatttacttccaataacaaattttagttttgattttggtgttcgatgtgattaacatgatcaatgtcaactcttcatcgttagagcagagcctctgccccaacgtcatctcttcatcttagaaataaatgtaatgatggtcatattcctgcttcttctgtacaaattagtggcaagtacaaagatatttactggtcatcaattattcacaacattgcattgctgactcacattaagttgtcccagaa

SEQ ID NO: 261 - DNA, 392822 bp, Homo sapiens
ttgggtttgatgaatattacggagcaacgttgcagtgtattttaaaattatactcaagaattcattttgtgcaccttattttaatgccgtatttccattcaagctctgcaacccaaaacagtctgtgttgattcttttggcattgaaaaaattatccatgggtttatttcatcatttcatggcagtaggagcttcaactgctatttgttgggaacccatcctgactagctatttcactggggcttcatgttttattgtgatgattggcagacttgtgtttcaggaatttttggctttggaaagttactatgattttgaaattatagatgcaaaaatgtcactgaatttattttcacaaactgttttaattcattatagacaataagtggtttaatcagaaatcaataatttaaataatcttttaatttgttggagcattcacaaatactacatcttcttttaagtctttcattattctacatgttatatacatagttaaattagttaataagagtgttacatattttccctccttctccaactatccacaagctgaggcttaaaataaacagtggaatgagtaaagacccgaagtaatatagcagcaaagctgtagttgaattttataataaaataatagatatcaaagtttcctgacgtttttaggcaaatcttcctgtgtccctaaagggaggatccccttgacaacagtcatgaacaacaggtgatcttgagattcccagctgtcaaagacagttagtgggaaaatttgaaagcaccttgtacgtatttttaaatcttagttgcatttctagttgtttttagtttcctgtggactatatttatcctgcaatcactggttttattggttgtccttcatattcttgtatttctctacatgcttgtgaatttgtattttcagcttcacttaaagaaggaaatatactttcacacatttagtcttccagtctttagtttccttaactccctttgccacgttccagagtcctcagtccaaagggacatcaggtatcaaggctcagtattccctgcccatgatgagagtaggatggctgatcctcttctcactaagccagggaggcagatattttagttcctggttatgtgtctcaaccctaagcctacacgcttaaaataagctaaacaccaagcagcataagaaacctgcctctctcagcttgctttcctctggatttatttgggtaaatctaattccaattctcccacctaggtaaggaagatgaagtcttagttatttcagaagaaaactcttggtgaatgttgagacctgttatcagacccctggctttgtcctatctgtatctaaattttctccatagcatttacctgcattgatacctgtttaaaatggaaggggttcaacatgttgggctatcttgattggaaatcattatttttttgtggaggggggagggcagggggtatttttttttgtactccaataaaaagtctcatcataaaggaattgtcacatagaaactcttgcccttagaaattgtttcctttgggtgtctacccattaatgggatttctgggtcaaatgggagttctagttttcgttcttagttctagttttgctctttgatgtggctctaaatggataattggaatgagagagaactcctctaggaaggaaaataaaatagaggtattggtagacacagaggttcttttcgttccatttacaaaattggtgggcggcaaggagcagtgctgctagaggtcttgctctgcccagatgcataaattcttctcctactaataagcactgcttgatgtcaacttcactgcatcctattactcattgtaggcatgtagcatgacaattaccccctacccctcttcctacttctggtcccaaacattatgactcagaatcaacccaggtgtccatcagtggtggattggatttttttcaaatgtggtgcatatacaccatgaggtactgtgcagcaacaaaaaaagaaagaaatccatatacaccatagaatactgtgcagccataaaaaaaaaaagaaatcctgtcctttgcagcaacatggatgcagctggccattgtcctaaagaaattagcacagaacagaaaatcaaatatcacattttctcatttacaagtgggagctaaaccctggatccacatggacataaagatggtaacaatagaccctgaggacttcaaaacaggggagagaaggagtgggctatgggctgaaaaaccttcctttcgggtactgtattgactatctgggtgatgggatcagtacaagcccagacttcagcaataggcaaaatatccttataacaaatctgtacatgtgctccctgaatctaaaataaaatagaaatgtaaaaaaataaactgtttcctatttagaactcttaataacatctcgggttggtgtctcttcccgatagaaaaaggtgtagtgtttttattctttttccattcctgggcactatcaagtcaccatgccttgaggatggacacaaaggcttcctctagagcagcaggaattacaaattgaattttataatcctgctacatttacagtaaaaggcatggatgaaccagctgtaaagatctatgatgctggtgatgaactatcttttctctgtggttgctggacctaagatcacaggggtgcttatctgggtctttagcaagagcagattctagttgcccgcccaacttttggcctcagatgaaaagcattctttggtctggtctttcctagccatgggcatagactgaacagcatctctcaggaagcacaattgatcttcagatgaaaatactaaaaaaaaaaaaaaaaaaaaaaaaaaaaaaaagaggaggcgttgtggagaaaactggtttggtgtaatctgccaacaattcttttagttcctctgtactggtgtgcagaggtgcataagaaagggattttttgctcagaattatttagtctatgattagttacttatagtcaagagtagtcatggaacttgttagttatgcgaaattggaccaaatatacttctttaagcctcatgactgatttttgtacaataacaattagcatattttgagcatttgaaaggagctagaggttcaatgccttacatgtggggttacatttgatcttcataggctcctgagagggtaggtgcagttgctaattctgttttactaaatgcccaacatcacacatagatgacagctattcctgagacttacaaaatgccagctcatgacattatgctatgctgcctcccgtacatcatacgggagtaattgtttctgccttactagttaactcagaaaagtaaatgaggcttggaaagaccctagctcaaagcacatactcaaaagtattagtttatctgcagcatggaggtgatatccacccattgagatgccagtcaaactctcctggggttttttgtcatcacctgctttccctaaactagcattgtccttgacacagctgtgtttgtggtgttttttcccctctgtttgtaggcatttttgtagcactacttatttgctgactcaagggctcagcttaagaccttaaacgcttcaggggaaatgttttttttccaaatctaatgctatgatttacatcaagtcctatagtatgacacggggcaggattgagacaatactctggctatgtgaatgaagtgcaggagactgtattaagaataaggattaatttatgtcttgtatcccatgtaagtcatgacgtttggggccagaagcagagagaggggtgtcgggcgtaattatcatgctacatggctacagtgagtaataggatgcagtgaagttgatatcaagcagtgcttattagtaggagaagaatgtttgcatctgagccagagcaagacctctagcagcaacaccccctcttccaatttggtaaatggaacaaaaagaatctctgtgtctaccaagacctctattttctttttcttcttagaggagttctctctcatcccaattatccatttagagccacatcaaagagcaaagatgtgggaataaaatctgtaacctgcacttctatgtgtctctaaagacctttagagtaattgcagatgagaccaaaagacgttttttaaaaagaagggtcagcttcaatcacaagatcagaaaaacctgacaaaccttaagtttctttgcaaaataaaagcacttttctactttaatgagaaatgatcagaaaatagtcttccctgtacttgcacacagtcatgtctcccaatgtaattggtagaaaatagctaaaagcatgaagcaagtccgtggagacatcacaagatcatgtaaatggattaaaagtgaatccagtttctttcgttttaacccttgaatattttccctttttttccgttctctttttacctttttctttgtttctactatcttgccctcttctgaacttgcaaggttcacaaaaactattctcagaagaatgcttccgacagttttcagaacaagatcccctcagcgattccaattaaagggcatgaaaaacagtaacaatcaccaatcattccaatgacaagttttaccgcactgctacctgggccaggacacaggttcgtggagttttctcttctcctggccccgtttaactccaatcttgctttggtttagaggctaccctatcttcaggtgctccctaatacatatcaggaaagtaaagcctttcaccttgagtcaccttcactagtttgtgtcatgatctttgtaactattggccttaccaacactctgaaaaaggcttaataacaaacaggttatgaagagaaagataagtgtgtgttttcaccttcttatttttatttctttctgactcttttcactgatatcccccaccccaccacagccatctgcagcaactctacccagcttccaaaatttatctatcccattgctactctgtgataatccccacagcatgaagtggtctctccttctttaagctatcttaccactattaccagacagtggctcctgatataatcacacatacatgtggatttttacacttcttagggggatagtagcctattcaagggtgaggaccgtaccttatgtctcagtatctatggcttatttagggtaggtgcgtataaactaatttttattgctgaaatttacaattagcagtgaattgtattttttgtgtgaagatttcctcacctactaaaatatttcatttatgactatgttcatttgaaatacaaggtgaaaatgaggtgaggtgcatgatatttcaatgcaaacgtaaaaacaaatgaaggcatgaggggaagagatccattttttaaaatatgtggttaaagtagtaaaatgattcaaataggtttctctgccccaaaatgccaggcttctctctctcttagaaatatgtcctgtgcatacctagctctatatgctttccacataattgccagcatgatgttcttccctctcctcattttctgctaaactccatcatcttaagtccaactgaagacccactttctccaagaaaatttctggactcacactccctacagtagagatctcattttttatcatttaaattggaatggataggccaggcacggtggctcacgcctgtaatcccagcactttgggaggccgatgcgggtggatcacttgaggtcaggagttcgagaccagcctggccaacacggtgaaaccctgtctccactagaaatacaaaaattagctgggtgtggtggctcgtgcctgtagcgggagaatcgcttgaacctgggaggcggagcttgccatgagccgagattgcaccacttcactgcagcctgggcaacagaaaaaaaaaaaaaattggaatggacaataacaaatgaagcttatatatgtcactactgtgctcctcatatataataataatttgtatatcttctactagtttgttttttaaataagttaagagcaaagactacacttttttcttccctcggaatttccatttcaccaagcaccaaaatttggtcacattttcaggatcaatgtttcattgttgatttttgattcatttacttacttttgaaataacttggttcctggtttttatcaggatatccctttcaaaacttgtattattctggagcattaatattgcaggctggacatcaaaagtaacagagggcccactctctgtgctttttttttcctttttttttttttgagacagagtctcgctctgttgcccaggctggagtgctgtggcacaacctcagctcactgcaacctcggcctcccgggttcaagcaattctcctgcctcagcctccttagtagctgggattacaggcgtgcaccaccatgcccagctaaaagtttcaccatgttggtaaggctggtctcaaactcctgacctcgtgatctacccgcctcagcctcccaaagtgctgggattacaggcgtgagccaccgcgccctgccatctctgtgctcttaaatggtaagtcattgactcatcctagagaaaagtctacataggctctcatagattattagagccctggatctggttttctgcaattctcttggtttttccaaatttcttcccttcattctggcatccttcttgatcccttgtctaccacaccacttaaatctctgtctaggaatgttcacgcattgtgtagaggcattggtgttaatggtattatctctgaatccatcccaccgcctggaagcaggacacccttggttttctatgtgagaggtaactcaagcagtcactatggaaaggaagcagcattcacatttttggtggttgctgtggacttatgcaaatcaggacccctcacccccactcccaaaaaaacccctctgatccaaatgctaatccctctggaaataccattacagagacagccagaaataaatgtttttccaactatctgggcatcccttagcccggtcaaagtcacttattaaattcatcatcatattttgtattagagtggagcaaaagtaattgcggtctttgccattgaaaatgatggccaaaaccgcaatgacttttgcaccaacctaatattagaactaaaatagtaatttcagagaaataaaggtaaaagtttgtgtgtatatatacaaaataaaaattaattttgtggaatcccatttatctccaccatagaattatttgatataccttcttttaattaaaaaaaatatagtgtttatggccaggtgcagtggctcacgcctgtaatcccagcactttgggaggccaaggcgggcagatcacctgaaatcaggagtttgagaccatcctgaccaacgtggagaaaccccgtctctaccaaaaatacaaaattagctgggcgtggtggcacatgcctgtaatcccagctactcaggaggctgaggcaggagaattgcttgaacctgggaggcagaggttgcggtgagctgagattgtgccactgcactccagcctgggcaacaggagcgaaactccgtctcaaaaaaaaaattacagtgtttataataaatctttaacatcttcaaataataatataccatgtcatgtgtgatgtaagacactcacagccatatccctaccctccctgaccattgtgctatttttaaaacacatttttcactttgatgtgtgtggtaaactcgtaattattaaactttgctttaaattgttaattatcttttcaagaaactttaaagtgagcaaataagtcttttataccctctcacatatttcacactgtgtctgtcacggtttggatggattcagtgttccatctggtaccactcccatcctacctgaagagctttctttagcatttcttgaagtgcaggtctgatggagaaaaatgccctcagcttttgtgcatcttaaaaagccttaatttccccctcatttaaaaatgatatcttcagtgtatatagaactgtaaactaacagttgtttttccccctttttcacactttgtgggggccattccattaccttctggctagcgcagttcctgtggatgtaagagcatgtgtgtcttaattcacagaaagagaaggctacatagcagttaacagattgactaaaattgatttatctattctgctcaagtggaatctaggtctgctaattcctacacaagtttgcctcaccaagatatatctccattattcacctgggtatatttattggggtgatagataacaaagtacctacagtaaactcatccaattttgaggaaagaaaatgtttaagtttaattgactaattcctcacagtaaccaaagggtttccaaaatgtaggtgtccacactgcttctttaagtttatgctacacttattggcattgatatgccattgtctgaatgctcctggaaaccacaactatggaaggagtgaatagagggtgtttcttctagtcaaaattttaacttcctaatttatttacttcatagctgaatgtgtggaactaacaagtttcctgactcttgactataagcaactaatcgtagcctaaataattctgggcagcgagttaccccctttttttttagatggagtctcgctctgtcacccaggctggagtgcagtggcgcaatctccgctcactgcaacctccagtctcccaggttcaagcgattctcctgcctcagcctcccgagtagctgggactacaggcgcccgccgccacgcctggctaattttttgtatttttagtagagacggggtttcaccgtgttagccaggattgtctcgatctcctgacctcgtgatccgcccgcctcagcctcccaaagtcccagaatgctgacattacaggcgtgagccaccgcgccgggccacgaatcccttttttatgcacctctgtacacgagtatacagtaggaactaaaagaaatgttgacagataacaccaaaccagttttcttcacaatacctcctctttcttttactattgtcatctgaagatcaactgtgcttccggagagatgctgttcagtccatgcccatggctaggaaagaccagaccaaagaatgcttttcgtctgaggccaaaagttgggcagggacttgacagtgcccaggaatggaagaagaataaaaacactacacctttttctatagggaagaggcaccaatgcgacattactaagaactctaaattggaaacagtttttttttttttaaacacttatcaggagtgattgattttattattattttttctttatttaactgggtaaacaattaatttgactacaatcagccaatttattttttagcattctgtatacacactcttaaaaattgtgttacattgaatagatgttttattgttgttgttgttgccaaaatttgtagcaaagagtttcacattttcatgacaattttaacatctgggaacattgttcagtagggacaatagaggcacacctctaagtcttccttctgtccccattggacaagaaagagttggggagtgttgactttgagttgtgcctagagaggaaaatgtgcatttattctaccagcttggatcattttttttttaagtaaaatggttctgtctcttagcttttcttttaaagagaacactgatatttcaggtaatatgtgaaatgttttgaaatgctcacaaatgaattatagattaaactgaaattacttgctttggtttttcttctgttgtcattgtcaagagctcccaaatgatcaagggtgaaagataaaaatataaaaaactaaaacaaaaaatatgggatggaaaaataaaccaaaaactattaagaagtaaagtctggttgattatgaagcaatgacaaggtccttagatatacagaaattgtgtattcctttcagaaaaagaaaatgatcttgaaaaatacctattactacccaaaatactacttacaatgtctaattgcccaacaacatgttaccgtgaatacagaatagaacatggtttgttccaaattgagtgcaatgaatttgaagagtaggtcagaaggatattactggtttgtaattatttgtaaatggcctggtttcagcttatagctgtcgcaaacctgtttgccagtaggtaccttagatattagaattcctgaaattctaattcttgcaatgcccattatcttatttaactaaattcatcaaaccacacataaaaaataataaaaatgaaagcatagcatcacaagtgaatttacttgggaaacttcatctttttaaacacctgatatgaagtgacctactaaccattacaggctattaccaaaaatgtcacaaagaaacaaaagtatatacaatttacagcaatcattcattattgatttaagaacactaattgaacttccagtataagccaggtaatgagtaatgctataaacaaataaagataaggaaggcaagttccctttctggtgaaggaatcagatggaaacatacaataattctagttcaatacaaccactgatatgctctctgagaatcattttctaaacatcttagcagatgatgtattagaataatcattacctataggtagattaccttgattataacagaataagtagttatcaatagataagttaaaaataatttatatcttgcatgctggaatcatttatttgcaaaccatcttcattatcttaaactgaaagttgtacctgtggtcttccagaaaaggtcgtaactcaaaagtgtctaggcttagtgaaaaagggttgtggcaaatatataaataggcaaaaagacaatgcatcagaaaagagtatagatactctattctcagaacagtggccttaattttaccaatttctgaaagcaatgtcataatttcaaacaaaaccaaatatttatggcatagaaatttcactttgatgtgacagtcacacgattcttcacaagattttattggctcatttctctatttataaaatttttcctctatgcaactgtatgttattatgaaaattatctgttcatgatatattacataaaaataagcttaaccattcaaaattatctattctttatctattacataaaaataaccttgtctcctgctttgtgttatgcaaatgctagaattttagcatggaaatcagcctaggcctgcacttctgaaactttccagtgcccataaacacctgaggatcctgctaaaatgcagatgctgattcagcagggatggggtgggcctgagatgctgtgtttctcccaagctcccaggtgatgctggtccatgaaccacacctggagcagataaatcagtccactacatctgacccattttgtttaaatcatcactgaaagtggtcctgatcacttaactacaatattcaatcctggggacttccctataccctttcaatttacaaggcaattagttgtcatgcctgtcaggagatccacaaaatcaaactggctttcacttattcccttgcacaggtttctttaaagagatttcctaatttgagaaatcttgggcaaattgaaatggtttaccatgcattgttgtggtctctatgactgccattacaaaatgatgagtctaaaattaacactactcctgaggataaattagaaccatttgctgtttgtttctttttgttttagtgtaataatggttgtaggctaatcaggaaagatgctggacacatgtgattctcatctcatctaattaaattgtaacacttaaccattaaagtgaataagctgcatcatagttttatttttcctaacaattataatttctgcaataataatattatctacaacttattgaaggcttgctatgtgctattttctgtataaaatttaggcattatttcactattttgctgcatggaaacccacttctgagaggttaatgcatttatttttttctaccacttacagcaagttaaaaacaaaatgtctctgactatagcttagctctcaagctgtcatttgactgtaccctttattttgccaatagaaggaaagctattgctatcgcatcttggaggcagatatgtctactcattttcaccttctcctttcctttccctaggggaagtccaatttttcatgaggttatctgttggtcattgcagctgagttgccagggatgtcttgggcatggaagcctagggttgagacccacctaaagctccccaatacttttctggggtcccagaggaatcaggacactgtctgcatccctttttcttttcctttttttaattgtatttttttggagttggggtcttgctttgtagcccaggctggagtgcagtggtgcaatcataggtcactgcagcctggacctcctgggctcaagtgatcctcctgtctcagcctctggagtatctgggactacaggagcatgacaccatatccaattaattgtttttttatgtttttagacatgatatctggctatattgcccaggctggtgtccaactcctggccccaagtaatcctcctgcctcagcctcccgaagttttgggattacagacatgagccactctgcccaactccaatccctttctctgattgccattttttactctcccatagccatttcatacacgtctatgtttccttctgaaggacaagactgcctattctaagaatttcagatgagaaaaaaaagcctaaatggtattttattgctccatctgcctcctgggaaagaacgcactttcctaccccaccaacacagacagtgcagtgacatcccttccccactgctcctttctgttgcaactcccatctcctttgcttgggaggtgttcatttcattgtgcatttctctcacttgagagttaaagacataaccttaatgttttgagctctctgggctttgcctcttgatatttaaatgcagaatttggaataaaaagaatatttctgctatgagctgaaagagaagtcctactttgctactcaaagccacagatttgactctgatcttgctaggttctgttgagcctgtccatttctggggcaatacccttctgcccaaatgttgattttaatggtgaggatttgcagaaaataaagaagaaaaaaaagcgtcagatatatttcaaaaaaaaattgtaccatagggcacattcatgggattagaaataagagtgcaaatctgaacaagatggtttcggacagtggtcattccaaaaataattaagcaactgacaggttttgtttttttcttcacatgttcagttgcagctttagaggttgaatcaacaatctgatttgtttatttaattaatttattttttgacagggtcttactctgtcgcccagactggagtgcagtggcacagtcaaggctcactgcaacctcgacctcctgggctcacgccatcctcccacctcagccccctgagtagctggaactacagactacaggtgcgcaccatcacactggctaatctttgtatttttagtagagatggggtttcaccatattgcccaggctggtcacgaactcctgaactcaagtgacctacctgcctctgcctcccaaagtgctggaattacaggcatgagtcaccatgcctggccagaatccaaatttgtaggagatatatatatacatatatggatatatatattaggatatatatatatataaatatatatataaatatatatataaatatatataaatatatataaatatatataaatatatatatataaatatatatataaatatatatataaatatatataaatatatataaatatatataaatatatatataaatatatatataaatatatatataaatatatatataaatatatataaatatataaatatatataaatatatataaatatataagtataaatatatataaatatatataaatatatatatatataaatatatataaatatatatataaatatatataaatatatatataaatatatatatatataaatatatatatatatatatgcttctataactttatttgaagtccaaaagagaagtgatttatttgaggtaaaatatcaccaaggttttatagaagtcatgaatgagactcttgaaacaatttggaagtgttaatataataaatccaaatttgttttccatttgttttgtttttgtttcctattctctttaatgaagaagcatttattatctagatattgcctcccaagtctaggatgaatctttttttcttgtcattttaaattgctgctgaaggaaaatttccattttaaaaaacctaaagcattttcgagatattcttataattccaagccaggcaaactgatataatttatattaatagtataaacattgacaaccataatgtattctttttccacaagagcatatggtttggttttgtttttcaccaaagttatgagtgattgaaagcagatattttgctaaaatgggtaggtaaatcatacacgtgcttggattcacactgaagtgtttgcagagtgtttaacacgaagctggggacaggagcctgctggtgtcgcactgagttatcatggtaggaaagtggtatcgtgtgacttgtggcactcctagaatgcctctgtgagctattgcatatgcacgcctgatggagaaagctgaccagcaggacactggcttctcatgaagtccccgcactagcatttttaacatgctcaagatttatggctcatgaattcagagacagaaatacaaatcttatgactctagttacttatgtaagacaataccaagcaatccatctctgcagtgtatacaggcactgaagggtgctgggtcttgaattttaaagtgctcacccttgcatttgaggaagtatggaaaatcgcttagcaatctccattctccactgtctcctagggatgcttctaactaacgcacacaaggaaacagggacaacaaataaacttacaggcttaggaaaataataattccacttggaatgttttaatttggtcgtttctacgtcaggaaatgtatactgcttttctaatggagccacactgtggtgttattcaatgatgtatgtcttctcatctcctctgggatttttttctgaagaataaaacattctcagctcttctattttaccaaaatatatacagttacatgatgacttaaatatgcacaactccatttctccatcttagcattattcttattttaggtgaaaaaaattcatagtaatttagaaacaggcaagatgcaaataacgtcatggatagtatatgaggtttccagtgaacatcatacaaagtaagctatctgtgtcactaattgatctcatgggaaacgtaagtagtatagaatcaagatcaagtggggatgtatcatttatgttcaagatacttctcatgttcattttaaatggcttcgatttgggatataatgaatttagttggagagtggacagcatacatgaggtaaggccttcatgggcaattaaggtacataacttaaaaaaaaaactgttccatgatgtattacttttaaaatttggccctcattcacagaacggagcaggagtgtggggcagtgacctgggatcaggtgtcacatgaaaagcggatttgtgttgaagctggcttccactgtacttgacataagattgacacatgggcagctgtcagtaacaaataatggatggagcaggggatgatggcgatgagcttcccattgaagaagccatttgtgtcatctctgtgagggccacacactgtactgagttcattttctaagaacaaggttttcattctaacatgatgcatctgggttcgagaggcatcaggagcttgctagttgaaagaagaagcatctcctctgctttagctaccgaaagtaaaatgttgaaacatatgcaaaagttatctgcctagccattcctggtggtggtgattcatgtgagagctgccaccagcaaagctctttcatgatgttcttttcagccttgaagaggctctaccatagtgggatttcaaaactcttaagaagagtaaagcactaatataatacttcagttttaattatcttggctaaccactttctgcccatttactaagtccctgagtgtatcattcaggggttagtgtagacaagaccctacacttcttttaggacagaaggagaagaaatcatttgagactacgttacaggtattatattcattgactgctaaatattttgacatcttttcattaagtagataaaactgcatataatgttctcaaacctcatctgaaaatacaaataagaaaattggccgggtgccatggctcacgcctgtaatcccaacactttgggaggccaaggcaggcggatcacaaggtcaggagttcaagaccagcctggctaagacggtgaaaccccatctctactaaaaatacaaaaaaaattagctgcgcatggtggcgggcacctgtagtcccagctacttgggaggctgaggcaggagaacggcttgaaccggggagatggaggttgcagtgagccgaaatcgcgctactgcactccaacctgggcgacaaagcgagacttcatctcaaaaaaaaaataaaaagaagaaagaaagagaaagaaagaagaaggaaagaaagaaagagagagagagagagagagaaagaaagaagaaagaaagaaagaaagaaagaaagaaagaaagaaagaaagaaagaaagaaaggaactcattggccatttatattattcaaacctatttcctgcttctaacggttccactgcctctgtggtttcccttcagacagggggactaaaggatgcatttttcccatatagagaaagattattggcacctaggatttctggcctaaattcctcaaaatgtaagtcatgccgatactattcctgaaaaatcgataatgacattgaacttgatgaataacatgaacaactcatgtccatgcaattaaacttgaattctgttactgaaagccaagattgaatgtattatttttttcacatttcatttatttgataatgctacttctgtgaacattttgtggaaaatttggaataaccacaggatgaggtttgcatcacattatattacagttcaccatatataaataagctcattgtcaaatgtatattattaaagtttgaatcgagaaaagcataatagtttccagcttttacattttggtattgggctttgcaaaaaaaattgcaattgctgttaagaaggcatcctagacattatgcaggcacaagtggtgtaatcccaaacagcttaagaaacctaaatattgttaggtatggttctgcttaaggtaagtttccctgcagttcatgctgcagggtactgagctgtattcttgttaaatatttaccataagttactgtacttcatttctgtttcccacaaactgagtcctgtgtatcagatagcctaacaggacagcacaaatctttcagaaagtgagatccactgctgaagtcaattcagccaaaaatttcatcagaatgagctaaaaaaaacaactgattacccagagatgcatcattgtttagatttatttttgattattccaactttcgtttctggttctctttttatttttataaatttttattttatatattttcaagcacacagaaaatatcaaagtacagtataaaatttgctgtaaacattcaaccagatttaggacatgttaaaaatttcccacagtggctttgctctatctatgttattgtggttttttgttttgttttgttttgttttttgacagagtctcactcaggctggagtgcagtggcacagtcttggctcactgcaacctctgcctccctggttcaagcagttctccctgcctcagcctcccaagtagctgggattacaggcacccgccaccacacctggctaatttttatatttctagtagagacggggtttcgccatgttggccagactggtcttgaactcccgacctcaggtccgcccgcctcagcctcccaaagtgctgggattataggtgtgaaccattgcgcccaactgctttgctctatctgactgtctatctatctatctatctatctatctatctatctatctatctatcatctacctatccatctatttgtatctatctatctatctatatctgtctatctgtctctctgtctatctatctgtctgtctctctatttgtctgtctggctggcttgctggctggctatcgtttgtctatctatctgtggatctgtctgtctaactatctttctgtctatctgtctatctatctgtctatctgtctgcctatctgtctatttgtctgactggctggctggctatctatctatctatctatctatctatcatctatctatctatctatctatctacctacctacctacctacctgtctttctatctgcctgtctacctttcagtctgtctacctttctgtctatctttctgtctgtttttctatctgtccatctgtctgtctgtctgtatgtcttttcgtcctccgtccatctatctgtctatctgtctttctttctgtccgtctatttttctgtctgtctgtccatccgtctgcccgtctgtctgtctgtccatctatctgtctaagggacctgtctgtctttctgtctgtctatctgtctgtctctctctctctctagctacctatctacctatcatctatctgtcttctctcccctaagtgttttcatgcacacaaatacacacataacacacacaattctatatatctatatatgtatatctatatatgcatatacttttctgaactacttgaaattaagttgtagatatcatattcacctaacaccaaatattttggtatgaatttcccaaagataaaaactgcacgaacctgatacaattaacaaaatcaagacatttaacattggtacaatactatctaattcattgatagtattggtatcattgataacattggcgcagtactatctaattcacagtgatactgaaaatttcttcattattgctatactgtcttttttagctatatttttttctggtccagtatccaattcacaatcatgaatgacatcacattgtctggtaactttactttccttcagtctggaacattctctgtttcttgtttgttcatgaagctgatatatctgaagacaggccagttattttgttgaacatccttcgatatgagctggtttaatgattcctgataactggattcaatttatttatttttggcaggagtaccatcaaaatgaggtgtgttttctctagtaccttatgtctagatgcacatgatgcctctgtctcattattggtgatgataaacttcatcacttggttaaaatggtgtctcttggatatccccgtacaaagttattaattttacctttgcaatttataagacatgtggtattgataagaaatcaatgggctatttcagactatgtatatatcatatcttgttcatcaaattaattttgtcatctagttggccttgatgccaatatggtggttacaatacaaagatttcccaactccatcattctttatgtgtttctcacttggctatctgtgaggaagtgctttgcattgtcttctatcattctattcactatccgtatgaattcctggatattacaagtgcacttttctgaagttacccctttcaaaatggcacctgtgtaattttgacactttccaagcatttattcatactttctgacataacattaccataattcctcagatgtcaaaatgaagataaaagtaaatctagaatgatgatctccatctattaacttattaagagaatacattgacatacatgatgataaatacttttatctctaacaatgcttctaattgtttgtgacattcaaaattaatgcagataatattgcagagcacgttgagtctaaggccactttagtttttgcccaaagagctttcaacaagagagatgtccacagtcttctttgaatatataaatcatgtctacaaatcaaactcagtaattatgctgtgctgaaatatttgcataaaatatttgaatacaatcagacataatctggtacaaatggtggcaaaataattatttttatgaaaatccgagggtgttttaatgtcataatttagcctctgggtactaatttattggtcacctatttcactgttaccaaagtcttctcaatgattaatacctcagccacttttgcatagttctaggggttgagagtaactatagcattttaagagcacttatttcactaattgacattttctattataagcagagatcctgcaattctctgccttcttctttgttttgacttcaagagctgtaacaaatagtgaatctacttcctcttccatacaccactcctttaaatatttgaagagagctcccgtgttctgttggatactgtcattctttgctaaatactaccagttcccaattccatttttcaaaagtgctttcaatgataatttgctctactctggatactgttgagtctgtcacaaatggtaacaatgctgattaattagtatagtgacctgaactaccatagttgagaagaaaataagaggttacattcaggcttgttcagaaagagtgcagctatttgatgtctgtcaaaatattgtaggaggcagggcacagtggcttgtgcccttaatcccagcattttgggaggcgaaggtaggaggatctcttcagtctgggagttcaaagcttgggcaacatagtggaaccccatttctacaaaaagaaaaattacaaaaattagccagaggtggtgatgcatgcctggagtcccaggtattcaggaggctaaggcaggaggatctcttgcatccatgaagtggaggctgcagtgagacatgattatgtccctgcattccagcctggatgacagagcaagaccctatctcaaaaaaaaaaaaaaaaaaaaaaaaaaaaaaaaaagaccttgtagtagacagtggtgtttatttgatatcctatattgtaaattaagacaatggcttagatataatagttagatgtggtctagcctgggtagcacacatgtgacattttataagaaattattctaatatgctgatttctaaaatcagttagaatttatcatattattagctcagaacaaatttgtagtcaactaaaatgtcaagatttttgtttttcctgtaacatgcttttgggatcatggtttattatataatcttattattgctagaaggcttggaaagtctcttggttggacaaattaagaaaaaaatatataatgagatgacactaaataaataaatgtcatcttgccatttacctttagcaaaattttcatacagaactgcagaatgtgtgagaacttatttcacttttgtttatataaaaattctttttaatgtttcaaaacatgagttacatcgaagttttcaagagaaaagttgtatatctgtatttaatcttcacctatgttcacctaactaaaaatatgaagcagttatactgcactaacattttttcacaatgttttgctatcctaaactatatttatatttacttttcatttacaatgtgcttgtccatcctattgtgtgaataatagcaatttttagggatgaaatagtaaaccataaggctatgcaaaacctaatggaaaagatctttcaggggattcttttgactaaagacagatgtgacagatgttatgaagtcttttaaaatttttcagaaagtacaataagtgatatccatagcagtcctgcagtctaaaatgataacttttgaaaagagaaaagttttggcaaactgtaaaatagaggtagacattgccaaagggaaaaaaattgctttggtttccacatatcaaaacactttttttcaacacatcaggtcaaaggtatgacaaaacgtgccttactaagtatccggaaggccttataatgctgctttacaccaaggaggtggttgctacagcccttcttttggaaaactcagagtgtgaggcccagttattctcttgcaaaaagctactggctgtaaatgagtggtttaaaggctgcatttgattctactccatgcactgaagtagcttagcatttatttaagattgcagtacagcagtagacaagaaaacaaaaaacacaaaggtaaatgttccactgtatatgtgcaagggatttcgctggaatatacatgtgcgaatatgtgtgtgtgtgtgtgtgtgtgtgtgtgtggagagagagagagagagaaagagagagagaaaacaccagaagatgagaaactcaaactactcagtgtggttgtagaaatgcagcttaaaaaaaaggtaattgaacattaaaacaaagctgtttgcaataagacattttcatgagctatttatgcctcatataaattctcatttcttgaaagtaagaccaaagaaatgtttaacgaacctttctgtattatgcagacctggcatttattatcagagactgcgcactgtacaatgaagtaaagccagccattcattaggtaaggtgtgtgtatatacacatatgtttttttaaataaactctttgcattgcatgtagttgaattacagatcaagtctgcatgttctcttccttccaacatgacttaagaagacccgtaagtaattgataaggctggccatgctttcaaaactagctagtgaagacttgctaaggggaaaaatcactatcgtcctgttcatttttattttcctctgttaagaggcaactaactgaaaatgttaacatttagagaaataagtgatgctttttagtgtgtctccctgctgcacactgaattcacctctgtttccacatactccatatttgccacaatcatttctgccttccttcttaaattaagagctccttggtgactggtgacaaaaaaatatttgtggtggattaagatccctctaaatgtcagctcttccacagacattattttattctcacaaaagtgctgcaagataggtgtttgtttgtttctttttgagacgggctcttgctctgtcacccaggctggagtgcagtggcgcgatcttggctcacttcaagctccgcctcccgggttcacgccattctcctgcctcagcctcccgagtagctgggactacaggcgcccgccaccaagaccggctaatttttttgtatttttagtagagacggggtttcgccgtgttagacaggatgatctcggtctcctgaccttgtgatccgcccacctgggcctcccaaagtgctgggattacaggcgtgagccaccgtgcccggccaagataggttttattatttccaatttagttaatcagacaataggctcaaagaggccaattaaccccctcaagatcacacaacaaatcaatttgttggtcaaattgatcaagtggtcaattttgggctttaaaccaactctgccaaaaattactatcggagacatttcaaccatcaccatagatcatgtgtattaatcttagtattctcaggaactgatggtgcttaatctataattaaggtaatttcagccaatatttagtaaatacctggttagctatttccaggtaccaaaaggtagaacacaatactttctatttactgagaaattacctggccaagtagttttctggagttgctcacattcagagatgaagtatagtgaatgcattacagcagtcgccttatccacagtttctctgtctgcagtttcagttacctgcagacaactgcagctggaaaatattgcatggaaagttccaaaaataaacaattttcagttttcaattgtgtgccattcttcataacatgatgaaatctcacactgtcctgctccatcctgcctgagatgtaaattatccctttgtccagcatctccacgctgggcacataactcgctacccaccaaagctgggcacataactcgctacccacccaagagtcatggacatcatctgctcctgacattcacccattagacatcatcatagctcaaagatctgggatcacccaaagcagatgaccctccttctgatgctttgtcagaaggtcaatagtagactaacactactacatcacaacgcctgtgccacaatgcctatgtcattcacctcgtttcatctcatgaggcaggcatattatcatctcacaccatcacaagaagaagggtgatgtattagtccattttcatactgctataaagaactgccaagactgggtaatttataaaggaaagaggtttaattgactcacagtttcacatggctggggaggcctcaggaaacttacaatcatggtggaaggtgaaagggaagcaaggcaccttcttcacaaggctgcaggaaggagaagtgctgagtgaagtgggaatagtcccttataaaaccgtctgatctcgtgagaactcactatcacgagaacagcatgagggaaaccacccccatgattcaattacctccacctggtctctcccttgacacgtggggattatggggattacaattcaagatgagatttgggtggggacacaaagcctaaccatatcaggtgagtacagtacaataagatattttgagagaaagaaggcgatatcacttaacttcacaagatactattataattgtttaattttagtattagttattgttgttcatctcttactgtgccttatttataaattaaactttatcatacatatgtaatgtatgtaggtataagaaaaagcagtgtatatagggttcagtactatccttggtttcaggcatccactccggatcttggaacatctctctcacggacaagagggggactactgtaggtgcctattgccatgtaacaaaacatctcaaaatataatggtgagaaacattatatgtattacctcacagtttctgtgggtgaggaattttggcattgcttagctgagccctcttatgagcctgtagtcagccgggacatcagtcgtgtcaagcctaggtggatccttttccaagctcccttgcaaggtgattggtgggattcagatcctcatgggctgctgcacggaggccctccattctttgttggctgttgaccagttctctgtcatataggcctctccatggggcagctcacaacttccttcatgaaaacaggtgaggaggcccagaaagagaaagaagaccataaagttagagtctttgtggcttagtctcagtagcgtcatcccaacacttggcagtgctccattcctcagaagccacttgctctttccagcccactctcaacaggatgtgattaagcaaggcgtgaagatgagggagcaggtatcatggtgtgccatctcagaaggctgctgacagcaacaaataacagaagcgaggccttggaagtgtttatctgcaacaggacaatcacagttcaccatatatgaaagagttaagtgaatttttttcaggcataataactccagctgacacccaaattgggaacatcaaaagtcactttctaagcagaatcatatcaatagctttaaatatcaggcaagcatattccttacaagattttttttgtagcatttattataacctcttttgagccctggatattatgcaaattaagtgagcattgtgtatgttttcttggctggcactcttgagatatcaaaagtgtgaaagagctggcactaaatcttggccttcagctctgaaagctctaaatgtaagtaaggggaaaaaagtgtgcatgtgtttatacagaatagaatatgaaaaagagcctagttttctttcttaacaggattatgcaatttaaaccttgttttcaaccacataaagacatcctttttcttgaatgacactattagactggaaagtgttaaaatatattcccttgaggttttctgtgagatcggcctagacactatacactaatgatgacaggatcaaggcttataaaactttagaatattctgatttttagtcgcattacgaagacaagagcctcattatctttcatcatttgtacttctgaaatactaatgtatgcgttgctcttctatacattattaaatttcattttaaatggaaaatgttaatatttaactcaatagtttaaacactattaatactaatgttgtctttctaatttctagagggaaaactttccaacttcaatttgaatcctcttaacttttatgttttcactgttcggaaagcatactctagtggcatggattatcctgaaagcaagataatgaaaatgaatttatatctaacctgaacgtgtttggggatttgagtatgcatccctaacatgggagaagttcacaacaattgaaatagttctgaaacggagctgtaaagactggactcaagacaagcagacattttccatcctactggtctatccctttctgcaatgctcttcctatttatctttcttatcaagatatcctcatctctgaaatggacagaagggtctttcataggaagagttgctgtgagctccttttagggattttgaacttgtggacattcactctaagaatgcacacataaatgcactatagtaaacaagtgagtaaatgaggaaacctgggcactcttcttttttcctttcattcataaacgggcatttcaaggcggttatttaaagctcatgtgaatttcaggaagcagttgctgtgcctatcctctgtggttccatagcacccactataaacatctaatagactgcattgaaactatctttgtatatatctatatgcccaactggattcctaggggaagagattcagcatttttcttctctagtacataacataatgtctggcatcaaccagatgttcgaacaccataaaaccatcaccaaccataaaaataagagcacacacgacgcccagatctctaaagcgtctggagtggtgttttggactggcagtgtagatattttctaatataagcattaatacagggaaagccagcagcaccttgacaaaggaaataattcagcctcctcttgacaaacatgtgtattggattttcccagtttcaaagccagaaaatcattccatttacctcaaacaatgaggatacatgtgaaaataagaaaccagggaaatcaccatcaagatgccaccttgcggaagagataggcagctggaatcactaagacgccctccctgcaagaacacgaacccaagtataggcagaataatggagagaagaaagcttgaatgacaactttgatcacctatcatcactttgttgctctcctattctcagaactttagtatttttcactactacttcctcctctctgttacattttctcttctgtttctaccaccagggaagtgtttccctctttttctttattgttttttaaatttatttatttatttatttatttttgagggagttttactcttgttgcccaggctggagtgcaatggcacgatctcagctcagcacaacctctgcctcccaggttcaagcaattctgtctcagccttccgagtagctgggattacaggcatgcaccaccacgcctggctaattttgtatctttagtagagacggggtttctccatgttggtcaggctggtcttgaactcccgaactcaggtgatccacccgcctcggcctcccaaattgctgggattacaggcgtgagccacctcgcccagctgcgtctctccttttgttgaaggttttcaaaatattgataagaaatttatgtgtaagaagccacctagatcttttctctcagtggggaactgtgggtgatggcgctttccccaaaatgggatgtggtggtgtgcagactcctggaattttgcaaaacccttattttgtttgaactgttttccttttagtcaaatgactttcaggccagttttcattatatggacagaccatagttaagtcatctactgtgccacaattgctacaataatgctgagcaaaagggatcatccaaaaacccagccattcataacagaaaacacttgaacattcatggctctgcaggggagctggggccactctgcttcaagcggcagttggtattcatttaaggttcatgtgccattccatcctttttttattgatggctctgtggacatgctgtcctgacagcagatcgcaggaataccgcagtgggaggggaaacatgaggcttcctgagactttggccccaggccggatccttacgccatcactcaattcccactggccaatccaaatcctctcaccaagcccagtaccaccatggcaggaagcaaaggcggctccctgctgcagtggacagcattgcagagccactatcctgcatgggtgcatcattcttggagcaggaaggctggaagaattgagaacagtaattcagccttcccataatgatgacttagctctgttctccataagcctctagaccaaacttgtccaacctattgcctgcatgcagcccagcacagccttccatgctgcgcaacatgaatttgtaaactttcttaaattattaccagattttttctttttttttttctttttttttttttttttttgctcatctgctattgctagtgtttgtgtattttatgtgtggcccaaaacaattatttttcttctaatgtggcccagggaagccaaaagattggacacccctgctctagaacttcagggatatgtttattcattggtttattctccccaggtatattaagagcataacaaaaaaagaaaaggaaaggaaagagggggaggggagagtggggaggggagatttggggaggggagggacaaaggaagaaaggggggaaggaaagaaagaaagagaaaagaaaggagagtagaggaagaaatgaagaaagaaaaaaaggaagaagaaagaaagaaagagaaaagaaagagagaggggggagggagagagggaaggaaaggaaaaatgaagagagaaaagaaggaaagaaacagagaaagagagagagagaaagagaaaagaaagaaaggaaagaaaggaaagagagtagaggaagaaatgaagaaagaaaaaaggaagaagaaggaaagaaagaaagagaaaggaaagcgagaggggggagggagagagggaaggaaaggaaaaatgaagaaagagagaaaagaaggaaagaaagagagagagagaaagaaaagaaagaaagaaaagaaagaagaaagaaagaaaaaagaaagaaagaaagaaagaaagaaggaaagaaaaagaagaaagaaagagaaagtcttgagttaaactaaatttcattggggaaaaatcaaaacattgttaacccacttcatagagataagtaattataattgcttacatatatgtgtatccagtgtgtttcttcaccaacattttggtaacaaaaaacgtagcattatcatgactacccagcatttaaaaccaagataagtggttgtctttcagattatctacaccaccaactgaatagagaggtgttcagttgaaaatgcaaaatactttaaatatttaaatattgtatccccatgatcccaaaatgtgacattaattattttgagtagttttttattaaatcaaaagaattcactgaatgaatttgtcttggtacacactttgacactcaagtgaacgcaacctctgaaatcattcttgattaagaaatcctgaaaaaaactcatctctactagatgactagataagccggaaagaggctttggtcattttaaatagaaatgctctcgttattcttctaaataccgtttgagaaaaaaccagatagtataatgtgggtttcatctaaattcatatctatttcctttctaagcatttaatctctgatggcaattcatgcattacaggacttagtatctgtgtaagtagatcatgtggaggaggcagagggataatttacccatctttcattaaactgccttggcatattacagcaggggccctaaacccttatttaagaactttaaaaaggattacattccaggaatcccccaatttccatcggcttgaatgctacagagatatgaaccacttaggctttccaacctcagctgcatccagtctaaaactactacagactgtaattcagcagcacatagtatctttccttgctttgttttggttggatttttttcaaatccgaaaatacgtgtagattcagaccaagtcataccacctgtcatgaggtgggtcaaacttctcaggttcttttctttctctcaaaatagaaatgtcttaggttctaatttagattgtcccaggttggatttctgttattgttattgaagaagatactgacctgagataacatcagtctctagctgggtctgaataagactcaacttggaggtgaggatccctaacacctgtcagctatagccttgagaaacattgttggacaaaaataagagctgaataatgccatttgcagccgcgtacttcacaggcggggcaaagcctctttgcccacagcaagctgagctggatgttgtgtcactttgttcaagataatgtgttgcaacctgaatcagaatacagattttaagttctgtaatataggcaatattcgccaaagactgttacaagaacagtacagatttttctattctggccaaattatataatagaattacctgcctctatccattagaatagcaggagagaaaaatgtgttttgtttttcagtatgagagagggagagagaaagttagtttatgtttcttaggagcagatattgagaccaagattttaatgtgatcacttttaggaagggatgtgagcctaggaaacatcagagggagaagagaagacaaaagaaggagctcggaaagggtgtgctgtcctataatacaagtgattgctgcgggcagttgtagcttcattctgaggagtgtctctgagaggtagagcagagcacacacctcagcattctcattcccaaaacaagagggagctggagctgctggtcaccaacacccttcagccattgctggaggccaatgtaggaggcattgtctcctggcatgtcctgtatgctttgtgctttgccggagctgaacctggtagccaggaaaggcccttgggcaagaagacacaggtgctgggaggtggaaaactggaagaccagagcagtgtccatgaaaattatacaaatcaagaagatatgggcaggatatctatacatctatatcatctacctctacaactataattgtatctatatctatgtctatatttctaactatgcatttgtatttatttatttattttttagatggagtgttgctgtgttgcccaggctgcagtggagtggcacaatcaattcactcctgcctctacttctcaggttcaagaaattctcctgcctcaacctcccgagtagctgggactacaggcgcatgccaccacgcccagctaatttatgtatctttttagtagagtgggagtttcaccatgttggccaggctggtctcaaactcctgacctcaaatgatcctcctgcctcagcctcccaaagtgctaggattacaggcatgagccactgtgcccgacctgcatttgtatttatggatacatgtttgtgtgcatgtatttatacacatgctggctgtgacttaaccaaaacaaaatcctataaagtaaaatgtccagattttacaaaacactttcataaacaatgaaagcttggtatcaacaatacaaaatgacctcaaaaacccaatcatttgtaaattgagtgatctacttgtaaatttaataaaaacatggtattaaacaatattcagatcaaagggaacatcataacagatatgtcagttatctaggaagtaatgaaaaggctaattctgtatgccaaaatctatgataaacctgtttatattcacaagctttcattattaaaatgaaaaaaggctgaacataaatgaaataattattcaatataagaaactagaaaaaacaattaaaatagtaaaataaaagagaataaagataaaaacggaaattactaaaatagtataaatagtagccaacagaaatatatccaaacatcatttctctgaaaataactataaaacagaaaaagtactagcatattagattgagaaaaaataagatggcacaaagaaatgaatgagattatgaataaaaaggcaataaaatcacagatttaagagattaaaagaaacattataagtgccggccgacaccccgtctgggaggtaaggagcgcctctgcctggccgccccgtctgggaggtggggagcgcctctgcccggccaccccgtctaggaagtgagtgcctctgcccggccgccccgtctgggaagtgaggagcacctctgccccgccgccccgtctgggaggtgtacccaacagctccgaagagacagcgaccatcgagaatgggccatgatgacgatggcggttttgtcgaaaagaaaagggggaaatgtggggaaaagaaagagagaacagattgttactgtgtctatatagaaagaagtagacataggagactccattttgttctgtactaagaaaaattcttctgccttgggatgctgttaatctataaccttacccccaaccccgtgctctctgaaacatgtgctgtgtccactcagggttaaatggattaagggcagtgcaagatgtgctttgttaaacagatgcttgaaggcagcatgctccttaagagtcatcaccactccctaatctcaagtacccagggacacaaacactgcggaaggccccagggtcctctgcctaggaaaaccagagacctttgttcacttgtttatctgctgaccttctctccactattatcctatgaccctgccacatcaccctctccgagaaacacccaagaatgatcaataaatactaaaaaaaaaaaaaaaaaaaaaagaaagattataagtgcatagtctatgtacttctatggcaataaatatgagaattctgaagcgagtggctagtttcttgcaaaaatattctaactggcttcccaaagaggcagaaaactgaatctacaaataaaggaaggtgttgaaaaggtaattaaagagacgccaggttaaaaaataatatacatcagacccagatggtttcacagttgtgttctacttgagctttaaagaacaaatcatttctatgtaacataaacttttctaggctaaagaaaaagctggaaaattgcccgatttcatgatgttagtgtaacttttaagctataacttgctaagatgagtggaaaatagtggaaaaaattgtaggataattctatatgcttattgtgcatgattaggtgcaaacattctaaattacaactcgatagattctactatattcaagataatgaccaatatttttaatattggatgaaagcatgaatgaatggcttaagatcatttattttattaaattaaaggagaaaaccatctgtttatattcatgggaggtgatgatggaaaggcatttggtaaattgcctaaaaatgtgaggctattcctaaaaaatctctaggtaagataagagtagaagaacatgaccattacttaacagcaaatatcattggaaagaaaaaagcaattatatatttcttttaaaaatcaagggaaaaatacagaatgaacaccagtaccactcttacttaacatggctttgaagattcttgataaaccagaaagctaaagcaattgttaaattattaacatatattttaaagctacaacaatgtttagtttgcagatgttgacactaaatatctagaaaattgaaaaaacaattaaaggtacttaagaattagtgaggcagagtagtaaaatgaatgataaaagctgtatatgtcaaaattgtcttgcattttatgccaatagaataaattttaaaattagattatatttttattcataatagcagctaaaactacagaataactaataaaatagattttaatatacatagattatatacacacctatatatgttttttcttttcttagtcaatcgtgtttgtgtgtgtataaacatatatttccaggaactttgtgctcacagtgaaggacaaagccacatcctgaatgaatgaagaaatataaaatattccttgttgggggggatgagaaacagtcatgtaacctattaatttaatacaattccaagcaaaatcttttgatacaaagaatgtaatgaaagagagcaacatgaatactctgtctcacttcccaggtcaatgttaacatagctagaaaatggaaaagtgcttaccttgctggtgttcagtaagcaaaatgtaaccctttcttatttccctcgttcccacacctagacgaccatggggccacgacagagaagcaagagggtgcattgcactgagaacaagcagcttgtcctctttctcccagaatagctcaccaggactgaactatttctacttaaaatattatacttctgggaagttgatagataagcatggaatgtcgagaaaactaaggcaactgaccatgtgtctcaaagagggcagccccataaacttctgcgaggcattattaagatgctctcactcttgttgctgcttttatacactactcttctgtgtttatagctgcaacgtcaatgggcaggcgaatttctacttctcttgtccagttgctagaggaaagcagaaagttgcacacataactgatggttgagtcagtccatgaaactccagacatcattccccggggttatgtggaggttagtcagactgcaaccctttttcattgtctttccttaatcctcatgaaaagttgcacttttcttttgtcgttagagctgatttagaaattgtaatttatgtttcattaatattcatttttgtcaacatgattattgttttttaaggaaatatttattgcatctacttattatttggcattgaccatgagatgatgtgattcgggaaaccttgataataaattttccctctggaattgcaaactctatccttctcactctgaactgcagtttctctcaattctttgcaatttcatgcatcccaaggaggtgaaaaatactcctctcttactggagataactttaaattaaatccctgatctgttacattttctgtgacaaaagggctttcttaagatattattctggattttgtacatcagcaaagcctgttgtttccagcctgttagtgtgatatatcaaaaatgcacacagacatataaatttctgatcaattattttgaaaactctaacccatatgaaactttaaccaatgtccatatttttaagttactatttttaatagccacacaataattccttcttcctgaaatattccatagacataatgtaaccctaggaaacccagttgccctttgcatggctgtggagaacttctcaatacttgattgtttcacataagggaaattagatttttaataaaaagatcacagttatctttgccagacagttaaatacctgcatgaagtactcattgaaaatatacttttttaatacaatgttttaaaggtatacccatgaagctaaaaagactgcaagaaacagaagccaaaaagactgcaagaaacactgcaaagcaaataccagctctgacagatgtcacgtggcatctgctgaaacacgaatggaggttttattaatgttcaactgtattgtgtacaatagcaacagctgattagcgatgggagtggaagattctgacttcactcttccccatcactgtttctctagctgctaattaaaatatctcagaaattttagacatctttttataactcattgtaatatttgttctccctcaaatctactccatacaattccatatgccttttctgacttacataattctgctttgacataaatgattaatacagtttgagatgaaaaagaatacaagtgtaaataaaaaactccctaatactgcgaaattttattttatttttatttttattgtatttttgagacacagcttcactctgtcgcccatgctggagcacagtggtgcaatcgaggctcactgcaacctccatctcccaggctgaagagattctcttgcctaagcctcccaagtaactgggactacaggcacgtgacacaccatgcatggctaatttttgtattatcagagatgaggttttgccatgttggccaggcttgtcttgaactcctgacctgaagtgatctgcccaccttggcctccccaagtcctgggattagaggtgtgagtctccatgcccatccataatgcaaaatttgaaaatgcctttgttttgtattaaaacctagttgtccaaaagatttcaaataaactatatatttgcacaaaggatcacagttatactttgattccttaaaaaaagggaaaataaccatgcttagaaaatgcatccacacttttcacacagcaaatgtactaaaagatcttcatttgattaaatattttttcatgtttgaatggaaaccacaagatctgtataacagacatgttcttagagtctaagaatgcttccttgataccagccagtttcagctgacatctagcaattctagtattcatgtgaacttgctataacaacatcaggatacttcataaagcaattgttgaaaaaaaaaagtcaaactctgtaaaatatttgaagagatttatcctgagccaaatatgagcaatcagtgtcccatgacacagccctcaggaggtcctgagaacatgtgcccaaggtggtcaacttggttttgtacaacaaggctacaacttggttttgtacattttagggagacataagacattaatcataacataacataacataagatatatacatcttatatgtatattggtacattggctcagtctggaaaggcaagacaactagaatgttggggggcttccaggtcataggcagattcaaaaatgcactgattggcaattggttgaaagagttactaactaaagacctggaatcaatagaaaggaatgtctgagttaagataacgggctacgggctacggagactgatgttttatcatgcagttgaagcctccaggtagcaggcttcagagagaatagattgtaaatgtttcacaacagacttaaaagagtctgttctatcagtcttaaggtcagctgtgtctgaattgtagaagggaagagggaataatgaagcatgtccaactcccccttcttatcattgcttgaactagttttccaggtaaattttggaatttcctgggccatgaactggggtccattcagatggttgaggggcttaaatttttatttttggtttacactatattgtagccaggtatgctggctcattcctttaatcccagcactttgggatgctgaggcaggaggatcacttgaggccaggggtcaagaccagcctgggcaacatggtgagacttccgtctctacaaaaatattcgaaaattaggcaagcacagtggcacgtacctgtagccccagctacttgggaagctaaggtgggaggattgcttgagcccagaagtttgaggctgcagtgatctatgattatatcacttcactccaatcagggcaagacagcgagaccctgtcaaaaaaaaaaaaaagaaagaagaagaaagaaaataatgaaagaataaagaaaaagaaagaaagaaagaaacaaagaaagaaaaagaaagaaagaaagaaaggaaaagaaaagaaaaagaaagctgtattgcctcggagcttatatgttaataagttttatgttctgaaaataaaaaaaaaccatcccaaaagttatgcctgccaaaatcaggattaaaaagatcctgaagaaagacatctcactttgctaatatgtgcagagtttgcattttattagttctatttcattcattaacttggttaatcagtgatttatggttggccaatgatttcaagatgagatgaaatttattaaagtcatgaaaaggcaagccatcaaacttcaagggacttccaaccacacagcccctgaacattgtcttgatcgcttggtgttgcaaatgcccttttggtggagcttaaataagatcagttggactgagaaagattgcttgatgtagagccattgaaacaagctgagtgtcttccaaggcagggacatccaatccatctcagatgataaccttttgcaaggcaggatgtccagtccatctcagatgataacccttcaggcatccgtcctggtgagcattgtttacccttcccctgtggtcacagtgcaagctaatactgctagctgcaaagctccataaaggttgttgtaatgcagagactcccaggaattgagggatgagatgaaagtgggttctgcataatggcccgggcagtaatgctgttgtaagaaactccaccaaacttcaggaggagaacagagccaatgttcagcgaccttcttccacaaaagatggtgaaaagtcttttttttgtttgttttttttctttttcatgctacaaattcactttgcattcaatttcaacctctgtgtttgttggatatctcttgtctacatctatggttatttccaaaataaaaagtaacatgtttaaacaataaggcactttcaaggaaaaactgatttatttctactaaataaaaattgttcccagtaacaaccatacctaaagaagttataaatctgtctttaattttgcaatgacaaatgaaaaatgttgactttttcaatcaaacaggtaattaagattgtttactgttgttggttgtgttaaacaatgaatgcaaaaaatagtttgctgtaatatacagataacacttaaataaatgtgccattaatggagaaaagatgactttttcccaggaccaacgtcttgccctcttcatttccatctgatgttgttcaaaacagtccactagcaaatacagttgttttgttggtggtggtggtttttagagactgcccgtgcatatataccagttactatatggacagttaaaaaaaatagggagagagaaatcaatacttgtcattcaaaataagctctcattatattctccagtagcgtatctcttgttctttcactgcatttcataagccttcctgcatgaccatcttcacattggtgtaattcttgctctctgtttttcctcctcttctggctttcctgggccacagtgagaatcagcatcttcagtatggattaatgcctgtggccctgattccatcaggaggcatagtgagaactgcaggaaaggccagtggtctctctcatttggaattattttttaggtcccctgcaatagtcactaagaaatctatctctttagcaggcactccataatagtgcagaatagaagagtttaaaaaaaagaaaagaaaagaaaaggaggaaaagatgagtgaggatccaaagctttctgaacaggacattagtttttgctgccatgcagtgtccaggagacagctaaatgttacagcaggaccaacctcagcccaaacctggttccattccttagggcaggtctggtgtctgccatcctgaaggtcggaacaccccatctggattaagtaagatttcaggcaaaattattttatctccttataaatcattgagtcattcaacatttatttattcgttagttcatgaatctgacatttctgaaatgcttatttccttggagaaaaggctggagaattgcataaaaaacagatacactgccctagataattctcagctctgtatactggagtttggataccccgtggaaatggaaatgctactgagagatatttcccttcctaaagaagtatctcctcacacaggcctcacctatccacaaagtgagctggaaaatgctcaagagttgtttttatcacctcctggaggtaattccataggcagtactaacctggctgtactctagtgattgttgtctcatttgatggtcttcaatgtagagtgaggtttataagaaaacaaattagatgtaagaagatagttctggaacttccactcatatttatttctacctaaatagttaagggagtgattaagacatgctatgctgatttgtaacagttggcttgacgttgactgcccacttggtactatgacagtcacgatgcataattttcttgaaattcgaagcaccctaagggcacacttgtagtctgtgaaccacagagcagccttgactgggcttttaatttgcttagccctcaactttcagtgtcctgtgacatatgcatagttaggcagatttgtgcattatttcatctaggtttaactgatcttgcccacacaaaatgaatatgtagcttacaattttcctgggaaagaactatggattcaaaatatttgtccatatttcaagtccaagagagaaagataatagctcagttgattcttggatttaattctaataggagattttcactatccatagtatgaggtgaacacagcacccatgtaataagatgggccgagcaattgcctgcggaatctgaagttatcaagagcattatttgaaatggaaatttgcatcaatgattgttagccatgaaccttatccctcgagatcatctcaaactgtattattaagccatcataattagcaagacaattagaagtcagccctcctggacaatatcaatgctaatatatatttttaatgaaaacaaaagggaatatgtaccatttgtaaataaaaatatatgaagtaatatttccacattataatttcatctcttaacctcatctttttttctacttctgtgttggttttacagtgtaaattatatgtgagtacagtaatgcatacctatactttgtaaagtaagaaatgccaaccaattgagaatgaatgccttaaacatttctactgatgggagtaaatgaacaaaaactttggagtccaaggatctgcttgctgggaaacagtctgggcagagaaggccacctcccttagtgttgcaggcaacattgcgctccgccagtcctgctctgtgaagctactgtagtttgcttcaagagagctctttttggtttttctgtaaaggaatgtagaagccaagaaattcccgcagatgaaccaaaataattattaacatcctgtaccaagattttccaaaatccccaaaataattccctctaatggtgtcataagtgttaccaatgctaggaatgcatcctattagacaggaaaactaatctgagcataatgttgcatcctcttgtaataaaattaggctttagataccttaagaaccttcacccacatctatccggcctcatttgaaaatgggaaggtgctgaaaaaatggttagaaagacaatctctatttttcaggtatttaattaaattattcaaccgaaaatagaaatagaaacaggaactccctttgtccaatcttagatctctccctctgttcccactgcagcaatcccaattccattacataatacacacatctgccccatacagagccacctaaatttgacctttacactcattccaatgcctgggaatcagaatgcatccattcttgaagcaaaaagcaatgaacagccgggtgcggtggctcacgcctataatcccagcactttgggaagccaaggcaggcggatcatgaggttaggagtttgagaccagcctggccaatatggtgaaaccccatctctactaaaaatacaaaaaaaaaaaaaaaaaaaaagtagtcgggcacggtggtgcatgcctgtaatcccagctactcaggaggctgaggcagaagaatcactttaacctgggaggtggaagttgcagtgagccgagatcatgccactgcactccagcctgggcgacagagtgagactctgtcaaaaaaaaaaaaaaaaaagcaatgaccaatgaccagcatctctttttatgcaccttggtctttgctacaggacctaagtaataaaagcagaaagcctctccccatagtctcactatccctttttaaaaataagaatctttgggaaacttcaagaggacattgcattggggttggaaattggaaagcaatgaagaactgtgaggcttcagttgtgttcagtcttgcaccagtgaggagagatgggcctgaagctccccatggaaaacctgtgaggttttctaacaactatggaagcgcccaaaacaaagatgacaccaagggttatactgctgggaattccatttcccaggctctccagcgctcccctcttatgggccagccggtctcctaaccactatttataaggatgcggtacagagaattgtaactggcagacctatagacagacactggtgagctatcatttgaaagtgtacaataatcacttacattagtaattcaatagctcaatcataatacttcaatgcactgtttttcagttgcaaatcaaaacaaaatcatcattactggctaataataggttattctgttgattaaacaaacttggattgttttgttggttaatagacatgggcatctcaccacccacacctcatgtaatattttctaaacaatatctaattaaaagatcacatgaacaaaatgtcttgtatctaacaccatgattggtctgttacaaaaatatgcatgagacaaggaaagacataaaactctgcaagttgttttcaaggttttattttaaaacaaaaacaaacgaaacctttactcttgcttccattgtcaaattgttgttgttttctttttctttttcttttttttttttttctgcacattggaatgttttccactgggggtgataatgcagcacagccatatttggtatgtctgagggatgtgtctgacttttgtgaaatacaagaagagtaattttgataagtgaagtagaaaagtagatgaagaatgatgtctacaacatgttgcatgtttcaataaagaatgtttttcatcctggagaaacacctgcgctccagattgacaattgccaactttgatactcacacccagaggcaacttggctttatgttaaagaccacactctgaagtcaccgtgcagctttgtcacttgtcggctggaggagctcagagaagcactcagcctctccatgcctcttgcttgtctgtaaaacaagaatgatgctaagacttactacatgcagtgttacggggattaaatgatgatgcatttaaaagaatcactttagcccaatgtccgccacattaaaaaccacaaggaattgttgcaggaagtcagggaccccaaacggagggaccagctgaagccatggcagaagaacatggatggtgaagatttcatggacatttattagttccccaaattaatacttttataatttctcatgcctgtctttactgcaatctctaaacataaattgtgaagatttcatggacacttatcacttccccagtcaatacccttgtgatttcctaggcctgtctttactttaatctcttaatcctgtcatctcataagccgaggaggatgtatgtggcctcaggaccatgtgataattgcgttaactgcacaaattgtagagcatgtgtgtttaaacaatatgaaatctgggcaccttgaaaaaagaacaggataacagcaattgttcagggaataagagagataaccttaaacactgaccgccagtgagccgggcggaacagagccatatttctcttctttcaaaagcaaatgggagaaatatcactgaattctttttctcagcaaggaacatccctgggaaagagaatatgtgcctgggggtaggtctatagacggctctctgggcgtggtcatcttttatggtctgtagactgtaggggtaaaatagatcccagtctcccatagcactcccaggcttattaggaagaaaaaattcccacctaataaattttggtcagaccggttgctctcaaaaccctgtctcctgataagatgttatcaatgacaatggtgcccaaaacttcattagcaattttaatttcgccccgtcctgtggtcctgtgatctcgccctgcctccatttgccttgtgatattctattaccttgtgaagtacgtaatctctgtgacccacacctattcgcacagtccctccccttttgaaagtccctaataaaaccttgctggttttacggcttgtggggcatcacagaacctaccaacatgtgatgtctcccccggacgcccagctttaaaatttctctcttttgtactctgtccctttatttctcaaaccggccgatgcttagggaaaacagaaaagaacctatgtgactattggggcaggttccccaataaggaatattagctcttgtttgtgttaggattgctgtcattaatattatgatcctgtaaggtatcaacaagaacattggatacacacagagacactattaattagaatttgttgtttgaaagaaggcatttcccagagcaactttggggaattagacataagcatgggtcttctggcacctagatacttttttgttctgtgcaggaggagtcagtatgagttaaagaaagctatccattatttaggatgaaaccaatgtacaagtgcagacttatgataatagtgagttaaggttgcaaatggaattcaagttgctaatgagctgactttacagtagggaaattattccagagtatttgggtgggcccattgtaatcacaaaatgccttaaaagtggaagagggaggcaggagggaagatcagaatgattcagtataagaaggactcaacctgtcaagttggcttggaagatggaggaggctccttgagccaaggagagcaggtcgcctctacaggctgggaaaatcaaagaaatggaatttccccttaagcctccaaagggagagcagccctgccgggtgagtttgtcagactgtgttcagaaatgtaagatcataaaattgtgttgtattaactcactgttagtggtcatttgttactgcagtgttagggaacagatattagcactcgtgatgtaattaaaatcattgtctttgctgcatgtggtaatgaagctgcaaatgacgtagatcaccttgggctccctcctttaaagttctcacccatcagacagtacacactactcctgggttttgtcatagctatttgtatgtatcacctacgagccccatatccagtcttggtaagtcaaggactatatcttttcagacagtatctcaccccaccatttattaaaagtattgaacggccactatgaagaacagtatggaggttcttcaaaaaactaaaaatacaactaccatatgatccagcaatcccactgttgtgaatatatgcaaaagaaaggaaatcagtatgttgaggagatgtttgcactctgaagtttattgcaacactactcatgatagccaagataaggaagcagcctaagtgtgcatcagtagatgaatggataaagaaaatgtgatacctataggccgggcgtggtggctcatgcctgtaatcccagcactttggcaggccaaggcaggtggatcatgaggtcactaaaaatacaaaaaaaattagccgggcatggtggccggtgcctgtagtctcagctactagggaagctgaggcaggagaatggcatgaacccgggaggcggagcttgcagtgagccgagatcgcgccactgcactccagactgggtgacatagcgagactccatctaaaaaaaaaaagtgatacctatacacaatggagtactattcagcctttaaaaagagtgagatcctgtcatttgcaacaatgtggatgaaactgaaggtcactatattaagtgaaataagccaggcacagaaagacaagcttctcatgttctgacttatttgttggagctaaaaattaagacaattgaactcatggagatagagagtagaaggatcgttaccagaagctaggaagggtagttggggggtgtgaggggagtgaggatgttcaataggtacaaaaaatagtttaaaagaatgaataacatctagtatttaatagcacaacagggtgactatagtcaataataatttaattgtacattttaaaataactaaaagagtataattggattgtttgtaacacaagggataaatgcttgagaggatgaatgccccgttttacataatatgattattacacattgcatgcctgtatcaaaacctcttatgtaccccataaatatatacacctatgatgtacccacaaaaattaaaaattaacaaaaaagaatgagatcctatcatttacaacaacatggatggaacttgaggacatttacattaagtgaaataagccaggcacagaaagacaaattttgcatgttctcactcacatgtagaagctaaaaattaaaacaatggaactcctaaagatagggagtagaaggatggttagcaaaggctgggaaggggagtgggtgtggagggtggggataatttggaatgattaatgggtgcaaaagacagaaggaataagatagaaggaataagagctagtatttgataccacaacagggtgactatgtcaacaataattccttgtatatttttaaataactaagagagaggaattgcaatattcctaacacaaagaaaggattaatgcttgaggcgatgggtgcccagattaccctggtttgattgttacacattgcatgctcatatcaaaacatcacatgtaccccataaacatattcacctatgatgttcccataacaattaaaaatttaaaaaaataaaataatttaagtatcaaatatgaacacaattttatgtctccctttttaaaaacttttgtgtgctctctccttttttgagctagctttttcttcctgcattgatattctacccatgaccctgcaattctactattctaaatcatatttctctgctatccacagccttttctggaattgacttactactcaattctggataacactattagtgagcaaaatgaagtgaaggaaagttttcaatgaccaacattaatgtggctgaaacgggttcagagaatctgctcagatccttgtcaaatcccgggaaaatctcacagacctgggttccccagcactggcctcaaattcctcaggctttctgggcttattgaatcaagggcattggttgtccttgaataaagtgtatagcatgtcaactaccaaatattttgctgcagtccagaaaaatgaaaagagaaagggagaagtagctgcaaaaatcctctacaatgccattcttggcatagaaaaatctagaagagcatgaagatgttagggggtggcgaatatccaaactattgatgggtctgatgtgttaaaataaaaacttcagccaaattaaatttaaaggagtttaattgagcaatgaacgagtcttcagagatgccttgtggtcagaaccaatttataggcaaaaaagggaagcaacgtacagaaatcagaagtgagatacaaaaataactggattggttacagctcggtgtttgccttatttgaacacagtttgagcacttaacagtctgtaagtggttgaagtatggccactgggattggccaagactcacttattgttacaggtcggtactcctaagttaggttttcaatcttgtcgacctactaagttaggttgcagttcatccacaaggactgaaatatagaagtaccaagtccttctcaggtcatatttagtttgctttaacagtggcaacctcaattcttgcctcctcaaaagaaagaagaaattcaactgaggggcataaggcagaaaaagagactgaggcaagtttcagagaaggagtggaagtttattaaaaagctttagagcaggaaagaaagaaaagcacacttagaagagatccaagtgggtgacctgaaggacaagtgccccatttaaccttgactctaggactttatttgctggcctgtttctggcatcttgcaccccttttccctcattcttccttaagggtgagccacgcacatacttgccttgggaggtgagcatgtgcagtgtgtttaggaagttgtgggcatgcccacctgaggctttcttcccttttccagtggaatgcccccagaaggtcatattctgccattttgtctcctaaggagaatgcccaaactcactcccaactcctgagattttattggaagctgcagattaccaatctcaactgtttggtaaattgcctatccctggggcctgcgatcaattatcactttagtgtgacaactgtgaattatcaggaaatggtctctccatggcggggcgctggctgccaattatcattttaagagaggcattgtgatcactgcccaaccatcacctgatggttgcctgacattcctgatgggaagcactctcccgccacactcatgcctggataactacctgtagcaaaattgttgagaacattcattcttaagaaagttaagagggagtccatacaaattataaatggagtgatacattagacactaatggagacacatggactctgacttcctaaaagtgtcacttggggaattattataggattggatgccaagctctatttccagatttacccccatggccctgagtgccagctgaatttttagtaagctaggccttcaggataaatatgcattagtcattccacctacgatacccggccagtcaaccactcatcaataagcatggtggtgaggactgaactttgaccttttttcgtcttttgcccaaattcctatctaaggggcctaaagagtccaccctacaaaccataacgtctcatcagaggggttttgtttaatcctatataacatggcctgctttccagcctgactctgacatagcatcgcatgacagataagaaaggaaatccaagtattttaaccccaaatgtgtttatttgccatatcttgaaatagccatgcgaagttgtctcctggggaagatctacattctatagagaatccctttcccttttcaaggtctttcttctgatccaggagagaatcaactaagaagttgacacctttctaagtctgataagaaacatttactaacatttacaatctactctctctgatgcctgctacctggaggcttcatctgcatagtaggaaccttggtctccaaaaccccttctctctctctctctctttttttttttttttgacaaaggttctcagtctgttgctcaggctagagtgcagtggtgcaatcatagctcactgcagcctcttatcttaacccagacatttcctttctattgattccaggtctttagacaaactcttttaaccaattgccagtcagaaaatctttgcatctgcctataacctggacccacccctagccctccacttccggttgtcccacctttccaaatggaaacaatgtacatcttacatggattgatttatgtcttatgtccccctaaaatgcataaaacctagttgtatagttgtggcctgaccaccttgggcacgtgttctcagggtctccggagggctgtgtcatagaccttggtcactcatatttggttcagattaaatttcttcaaatattttacagagctggactcttttcatcaacagtggtcggccctaagtgcatccctaggttggcaaagctttgcttatgggctcagataagtctcctcccttatggcagaagtgagaggaaggtcctctcccagccccaaagctcaggctttgtttcctgtgactaaagcctcccagcccaaggatcctggacacacatcaagagagctcccttggagccgagtcctaaatgtcctattgggggttgggggggagaaaagacaataaccctacaacaaaaaacaagcctagcaaatgatttcttaagccagtaaaaaactcatgcgaaagactctgtacagactcaacagagatttccaggacgtcatccatctccctaaaatacgcatttcaagttctccattgtgtttttggtactgtaaaatgtatgttgatttaagctgttctcatgttacacagtggggttgcttttggcctctgtgagatgccaagcaccttggcaggactcagaatccactccctatgcgactcctcggtgtcttcttcacttggcataggtgctgtggttgtcagcaactgaatgaagctgatgttttggctttgggccttgctagagaaagctgacatctgtccaaatgacaatacagcacctgtaaaggaacagagatgaaggtacaaagacgtcgctatctgtacagtggtgaagcacccacacctgcactttggagacagctgtagggcttggatttgcaaatcctggcatgtgcacagaattgggctttgacttgggtgtggtaacacttctgttagaatgctaggggaaagtctctttgataatgtggggtggggcatgacaactcattggcatcttctctcaagcttggaaccagagtcgcaaaaccagatgttttggttgaaggaagtgtggtaagtggatttgataataaggaaggcatcaaaatgctttgcatggctggtatgggaatactggggtgccttttatcaactcttacctctaacccgactacctttgggaatactttagtagtaaataattattgtgttaaatcatgccatgtgattaatttggggaaacagaaaattatcttcatgtggaaaaacaataatagcatgtcttcaaactactcagtcaataaacatttcttatgttgagagtaattatatatatatatatttcacatttgagatagttcattcgataatcacttatttctatacaaaatgtggtaagaatattgggaaacatttgcccatgaataatacccacaacatgcctcttcaatttatagcctaatttgacttggcagacattttgcactcaaaagcgtgggattgagccaaatctaacctcaccacttttattttatcaaaacctggaatatttcatcatagcaaacctgtaaaaggggtttctttttaattatcttcttaaaacatttagcattacaaattcatcattcgattggctatttgcctggaagttatcacacatgggaaaaatgccaatatttgcaaaccccagggtggtgaatcactgcaaacaaaactgatgactatatagaataattgttgtcaagtctttgacaaagtcctgaaaagtgtgtctcctgatgttttcaaaatgtactctgaaattaaaaagtagggttaatgtcctttgtaaaatgaaaatgattataaattatcccattacctagagaaggaagagaggagagaaaaaggaatagcttttgtaaaagaacttcggggttagctatattcattaatatacatcagtggtcaaacctaaggagtcttgcaagaaagttaggcacagccaaatcgcaagtcttcagttctgcacagagagtctggacaactacacacggtagtgattgtctctccagccgcatattagaatcaattcaaaatctttcagaacatcccgctgttcagattctgatggaatcagtaaagtgtagctcaaaaaacaaaaacaaaacagaacaaaaaaacacctcgaacatatcaagtcacattgacatttaacttgctctccacctctacatagataatatatttagtatcctatacatttactatcatatacattccatatgtatatcaaatttcatacttatatgcatagtataccatacatatatacacagtatttatacatacatacaacatattttatgatatataatattctaatatatatagtatctcatgcatatatataatacatagtactctgcatataaatggtatttcatgcagtagtacagcgtatttcacacatatatagtctatgcatatatacagagtatttcatacacatatgcatatttacccatagatttaacaagctatgtagtatcttttgcaacttgcccttattggaggacagtctgacaggcagaaaagattagtggttaactacaaggacactggaactcaatggcctgggattattttcaggctctgccactcggtagctatatgactttgggcttttttttttttttttttttttcttatggagtctcgctctgtcacccagtctgcagtggtgcaatcttggctcactgcaacctccgcctcctgggttcaagaggttctcctgcctcagtttccctagtagctgggattacaggccatgccactatgcccagctaatttttgtatttttagtagagagggggtttcaccatgttggccaggctggtctcgaactcctgacctcaggtgatccgcctgcctcagccttccaaagggctgggattacaggcatgagccactgcgcccagcctgggctactggtttaaatgatctttgcctcactgtcctcagctttaaaatatggccagccatagggtggctgtagaaatgaatgaaggaatgtcaataatgcacttagtgtaccttacaattagtggttcctcagtaaatgttagctgtagaggttaattccattagtggtctctcaagtaaactacaaaaagctacaggcagggccttgtgaagcatcctgtgccataccgaggtggaccaccctacgaaggaatgtaagatgcttcctattattcataatgaagcccattgcatatgattggctgctgtttgagatggggaaggaaatataggggatgaaaaggtcaagtcggcatcagttttgtattgcatgatagtctggtgctataagtataatgactgatcaatgctaattggctgtctctgtgactgcccttaaatcactaccagctgccccttggaagctatttcacaaggctcagaaaagagaagtcgtttccactaataacactcgacagcatcccaaattacatttgcctagccctatattttatcagtatttctcaggataaattccaaattatactcaaaagaagatcgaaaggaagacgcctgtgatagctctacctatatttatctacatgtgtatgtatttgcatgcattttcatgtctgcatctacatctttatatgtaacttaatccagggaatttgaggagaaaaacttcagtatattctgatgcactgagataaaaatgtgatgcttcaatatgactttttgcttcttcagctctgcaagcaggaatgtttctaacatttatcattcaatagcttctcagggtctggaagagtggtttgcggcactgggcacatattagaatcacctggggaccctttaaactagcactaatgtgcaatgtccatacttctctcctgatctttaggtgccagaggacactggacttcttaaaagctcccctgggagttctaataggcagccagttttgaaagcctctgacccagggtcagaatcatgctaataatcagagtcaattgtgcaaaactcaatctttaagtattaccttaatctgaaactcgattattcttcctactttgggcaatctttagttttctagccaataaaggatttcactcttctttttcttttctcaaatccacgtctagactataaatgtgcaccaggatttctctcagtgaaatgatttttcaaatctatagatttttacgtactcaaacattttgtttccttggacaagatggatttttctaaacagacttgttatgtgctcggccactttatgaaaacaattcactgacagaaattgaagatggcatcacatgcatattgagtcgatcattcctagaatgttaaagttaaaatcagcacaaagtacattgcactcagccctagggaaatgtgcaaaaatctgccatacctccttaaaactaatttatttaagtcattgtgtgtcccttagatgtttatctacttaaaacacaatgactcatttgtgtaaacagattgcaaataatttgtgtgtaaaattgaatagaaccaagtacatacaaacacccacacacacagaactgtgtgtatatcaaatctatgagatctgaataaaggatatggtttgtatcaatgtcaatttcctggttgtgatactatactgtagttttgaaagatgtcgccattgtgggaaactaaatgaagggttcaggatagttcataatctctattatttcctacaattgcatgtgaatctacaattttctcaaaatacaaagtaaaaaaaaaaaaaagagagagagagagagagagggagagactcctttaaagaagattggcaaatgacatagggcttggatttgaatttaaatttcacaaaacacagggagccctggactccacattgttccttatcagttctagttctcccaactacttcaatttcatacatagaatatatgtaaaatttactcagtaacatttactctacagtgttcccatttcaaaatttgctgtggcacctaaatcagacctctggcccttagtcatgatgcaaaagaactgtagtcttcagtacttatgtctttggtttcacggtctctccttctctccccacccttatcttagtctttctttgccttactttctaaatgccctcttaattctattttgtttccattcttagattttgcttttccaaattcttcttactgtgttctgtgtagattagaaccttctattacacagatcttacataaactgctcactttcctcatcttattctaaatttcattctgtcactgccagggattgaatatcaagaagtgttggtacaaatacaaccaactcaattttctattagttgctctaaattgttttagggattacaaaccttccacccccacccccaccttagtgatttggcattttaatttttttatatgattaattcaattttctttttcttcttttaacttttattttaggctcaggggtacaattgcaagtttgttatatgggtaaactcttgtcatagaggtttgttgtacagattattccatcacccaggtactaagcctagtactcattagttattttttcctgatcctctccctcctcccaccttccaccctcaagtaggtcccagtatctgttgttcccttctttgtgttcatgtgttctcatcatttagctcccacttataagtgagaacatgtggtattggcttttctgttcctgtgttggtttcctaaggatgatggcttccagctccatctatgttcccgcaaaggagattatctttttccttttttgtggctgtatagtattccatggtgtgtatgtaccatattttctttatacagtctaccagtgatgagcatttaggttgattctatgttttttgtgattgtgaatagtgctgcaatgaacatttgcatgcatgtgtctttttggtagaatgatgtatatttctttgggtatatatccagtaatgagattgctgggtcaaatggtatttctgctttcagctctttgaggaattgccacactgctgttcacaatggttgaactaatttacacccccaccaacagtgtataagtattcccttttgtctgcaatcttgccagtacctgctatttttttctttttaatgaaatacccattctgcctggtgtgagatgatatttcattgtggttttgattcgcatttctctaatgatcagtgatattgggctttgttttatatgcttgttggccacatgtatgtcttcttttgaaaagtgtctgttcatgtcctttgcccaaattttaatgatatttttttcttgtatatgtgtttaagttccttatcggtgctggatgctggatgtaagacctttgttacatgcataagttgcaaatattttctcccattctctagtttgtctatttactctgttgacagtttcttttgctatgaagaagctcttaagtttaattagatcctatttgccaatttttgcttttgttatgattgcttttggtgtcttcaatctgacatttttagacacacacacacacacacacacacacacacacacgtggatttttccaagcactgttacatgaccatcttcacagtaaccatgaagtgagtggcaaaatccttactttgggtgggaataccaaggcagagaaaggataggcaggcacactctctgtgtttctgcacaagagagggcacaatttttatttttatttttttttagacaggttctcattctgtcatccaggctggagctcaatcatgtgatcatagctcactgcagccaatacctggtgagttcaagcgattctcctgcctcagccacccaagtcgctgggactacaggtgtgcactaccatgtccagctaattttccattttttttttgcagacatggagtctttttatgttgcccaggcggggaccaagtgatcctcccgcctcagccttccaaagtgctgggattgcaggtgtgagccatcatgcctggcctcttactcttttcaaaaatttttcttggccgggcgtggtggctcacgcctgtaatcccagcactttgggaggccgggagatcgagaccatcctggctaacacggtgaaaccccgtctctactaaaaatacaaaacattagccggacgtggtggcaggcacctgtagccccagctactcaggaggctgaggcaggagaatggcgtgaacctggtaggcggagcttgcagtgaaccgagatcgcgccactgcactccagcctgggcgacagagcgagactccgtctcaaaaaaaaaaaaaaaaaattttttttttcttgtatcccctacagctttttctcctttgataccatgctccatcaatgggtggtatatgtagaagttgtctccaatttacaacaaagctgtattctcaggactcatttgtgtaaaaaaatacctccccaatggaaacaatactaaaaatatttcttgggttttcggtccctgccaagacactccactggccctaagaacctgcttaccctgtggtgtagctcaagaagtaaaagaatgtgaaggaagttggattcttattgcagccttcaagcccgatctctgggtcagtagccccagcctctctgatctttgatgaagaatggaggttggagaccagtgtgaggtgcccaagctgtgcagctgattggctgggtgaagcctcagagaatgagtggataagaactcccaggaaaactcccaggaaattcaggcctcagggactggggagggtcaagcctggggccactggcatgggtgctcatgctgtagggtggcggcagcagccattgaaagaaatcaaaatatttcacccccaaataacccttctttgacatatttagagatggctgttcagagggcctgaaaataacagccctacaaagctgtcttttgtgggggaaattggcatctgtagatgtagagaaaatctgcattgatgcattgctgcagccaggctttctctgacacccactccctgcccccgtgtctggatctaggaaaaattaactaaaagcctaacacctttaaggtctgaaagaaacagtcaccatctattctctctaaaggctgcgacctgggaggtttcatctgcgtaacaagaccacctttgctagtcaggacttctcttctctccctcccataaattgtgttgccaagatccgagcccccattctttctgtaacttcaagatggcataaaagcgtcaagcaatcctccactgatagccttgataggctgtttccatacctctactattgtgaatagtgctgtgataaacatgtatctttttcatataatgattactttttctctgggtagatacccagtagtgggactgctaggtcaaatggtagttctatttttagtgctttgagaaatctccatactgttttacatagaggtcatgttaatttacattatgaccaacagcatataagtggtccctatgtacataatggagtattattcagccataaacaagaatgcaatcatgtcttttgcagcaacatggatggaatggaggccattatcttaattgaaatgacgctgacacaaaaagacaaatgccacatattctcatttataattgggaactaaataatgtgtacacatgtacatagaatgtagaataattgacaataaacacttggaaaggtgggagggtcagagggtgggagagtgggagtaaagagaaattacttaatgggtacaatatatattattttggtgaatgccctaaaagcctttatttcttatgcttttttttcttaggcattttttccaattcatcagcaattatgggtcaattgcatgtcaaagtggggatgtacaagcctctcaaaactctacttagataatggagatttaaaggcttatagtatagtacgtagtattgaaaaacaattgagtagtattgaaatacaggtgaatgcttattggcattgcatatatctacaattttaggagtaaatattggtggcaaaagaaaaacagcttaaaattgtatatccttgacttaatataccactaaaaccatcaggagttacaattgtaaacatgatgatagaaatctgaagtgttggttgtcaaactccaagatactttcattaggatgaagtgctgtcttgttaacatttaccagacctcaaattccattaacactgacatggaaagagactttttgaatctccttggcagcaggaactgtccatttttcctcttaaattcaataaagtttcttttcttttttttaagtttggagacagggccttgctatgttgcccaggctggtctcaaacattcaggactcaagtgatccttcagattcagcctcccgagtagctgagactacaggtgcatgccactgtgcccagcaaaaatgtttctttaagaaataaatgagtcgactccttggtctggtttaaggatactttattattgaaccagtatgtacaaactctaacatgaaaataatgagtcacagaatatcaagactatttacaatacttttttgttttttacaaaacatttttacaagattacttctctctaaataatgtgacagacatacacaaaaatccaactttttttattacatacataaataaatattgactttaaatgaccactgtaagggacatgaattctacagaccacttggatgagaaggtagcagttttgttatctgcacactacaatataattaagtaaaggggaaaagtaactttatatagacctctgttaatcactccgtaaatcatataactcactagaatattcagtagaggtaagacagtcatgagaatcctctccgtacctgacaccgagtctgaccatgcaaaatcacaggtaagagtcaacatctttatatatctgtttatattttataataaactttaaagtacatgcaacagatatttagccattgtgttctgcctataatatgaaagtttatataataagttttagagttatttgcaaccatagaaatgagtaaacttgaaaacccacggcataagaaagggcattaaataaataagtcaaaatcacaaatgacatttacggatacatagggcaaaattagtatttgtacttgtatgatacagacacgagtcaaaattccgtcttttaatcaagttgtttagtggacataaaaaacacagtttaggcctttgaagtcaaccataataacttcttagctgtcccttagtttttgggacttgctctagaaattcactgggtttcttataaagggcaaattcagtaaagatcattctctagcaatggttctcaaccagaggtaccatccctcaaggggtagctggcaatatctggagacatttttggttgtctcaacttgggggagggtgcaactggcatctggtgaggagaaagtgtggatgctactaaaaacctacagtgcacaagacaaacccccacaacagagaactatccagccccaaaagtcaatagtgttgaggttgagatgaacctctgtatacagtcggctatgtatctaaggttttcaggacacagatgtatttctaatctttgaacttcgtttaatacacattacaaaaaattacctgccataaaccttatcttctctaccatgtcatattaaaacagtgaatgactgaaaagagcacatgttggtttgcaaacatcattctatggagttccaggtagaaaaacagggtaacacagataaattcatcattaaggagcaaatgttgtaaataaaaataatgcatgtaactgcaatgtatgtcagattaaccacctgtatttgatgacaatatttttgatgagctcaattttttaaacagtcaatactattactggatatatttttctcacattagagaaatgaatctaatttcaataaaacatattacagaattaggcaccaaaactatgtttgttaaaaagcatagattttattctttattagagcaatcacatttttaaaattcaaaaaattataactatatttttgatcatttgaataatactggagcttattaaaatccataagagaaacacatgttttttattagcccattaatagcatttttcttccaataacaccaataaaatttaaattatttatttatattaaaattagaagcccataagagctgctttagatttttttaagggagatgtaagcttcagaatcaccatctgaactaaaaatatctgtccaatgtctattacccagacaaaagaagcatgattaaattttataaaattaaatttatgtaataatttaataatattttgtatctatgcagagactcccagcatttttaactatgcaacagtacaaaaatttgctggcataaacatttgaatttgttcatgacaagttcatgtaaaagataaatggatagctaataatgaaaaattttaatttttgaaattttaagaacttgaaattcagatgctggtaatgacaccagaataaaaaagagaagctatctatggtatccatttattcaagcttagggatgttttcaaatgaagattgttttctatttttgccactcaaaaattcttagaaccaggtaatttcataactcaatgtgataaatccatcccagcttgtgacaggagctgcagtgaaccattcagaaccaacatgaactttcattctgaggtgtccaatttatgttacttgtacaaagctgcaaaacattcctggaatatccactttttaaatattttaacacacaggaaatgggtttcaatatctattatcaggtatccatgtttataaatgtgtttcccaaagacatgcatcaacatcagaaaagttattttccctgcattttaatttgcatctacctttagacactgcagtgaggctctgtggagtacagtgacttctgagttatccactcttcccaggaatggccaggcatctgcatgaattcaggaaacaataaaacaacaagaagcaagtaccattgtcaaaacctaaggataatgttactgattttcttcctgttttacttaggtaggtaaagacatatggacacctttcttttacagtgtttaattttgataaattgctcttttctcagaatcagcattgatggggaaaatatattatccttatgacctttaaaagagctgtatctttactcaccattggtgagctacgaaaacgatttctccagggattcatgctcaaggtatattcatgtatatgcatgtgtctgtgtgtatatacatgtatatgtacatatatttgcatatatatacacatgcatttataattatatagacatgcatatctatgcacatttcaaaccatgtatgtgagtattccttcaagaaaaaaaacagtattaaattaaacttctctgcgttttaggttgttacaatatacactgcaacactctatattgataacacgttttgacttaagttcatgctacaaggcactaatttgtagcataaaacatttccaaaaagtaagatatactagatttgaaagcatatgggtgaattaaatgcaaataactgtccttctctatcaatcaaaggaatttttaaaacattaccaataatattctagcacacaaagacctttctttgattaagaaaaggcaaatctctgcaaagatttaaacatgctcaatagttgggattttttcatttgaagcaagaagttttgtgaattttcagatggtgaaacaaaagtgcaccaaaagctattatctgcattgaggaaaataagggaaaatataaataagataacatatcaggaaaatctctcacataataggatcaaatattaaaaggcatccccaagaaataattttcatttctccaaggtaaaatctgattagcagcttatttcattgagttcctctggcttgggtgtcttttgtaaatcataatttatagagggaactttgatttacctttgcataaagagcagcacaaggtacttaaagtaggagcatttttagatttaaattcgctggtatattttagattacacattttcatttaaaaatcacctaggataaaaatgatcttaggaaagattcaaaaaaacaaagctgtgtaatcttagttgatttttcatatcgaatcaataatttagtcaaaaatatattttattgattagatttacgcttagtgttatgtgtgaattgtgtatttgttactctcctttttggggcggagtttggtgctccaaattcagggaaaactgagttctgttgtaattcaatagaaatgagcgacaccatacatgaaaacaaaatttagcattaaacaggcctattcttcattttctccatgcttgtagggaactggtgtctgtcttcaccaatctactgtttctcacttgtctccagatgcgtccatgattgacagaagttcttcctgcactaaagtcacataggagagtccgggcctctgagcagttcccactgcctctggaagtgtgcatgtctcgtggccgaagttcaacaagcttacacatctgtgcaatttcacaaaatctttttgaacagtttagtatctttctggagaaggcttgtaatgatgtggatgacgatgcttaagatgagatcctaaaaagtgacaaaatatgtcagtcacatccatttgtatgtatcaaataaatgatagaattacctttatttgtagaaaaagcacgagaccctggcaaatgttccttcctatgaccatgtctttcctattctgaatctgaatgtacaaccacactctttctctccttttcctgtttttctcttcctctttgatgtcttcccaaactataaaataacaagaaaaagaagacaagctcctttccttaagctcacacttatccaatcaaaccataatccttttttatttgctcaaagaagtttaaaaattatcaaatacttctgttaaaaggaatttctatgaaggaatatcagaaaagcatttatctgacaaaaattttagaggctatcaagctctcccattgtgatagtttttgtttttcttcaaattataagcataccaagttatcaattataagcataccaatctatcatttaaaaaaatcagagttaaaactatgactaattctcaatgttttgtccacacactagtcatcagacacttttttaaaaaatttaagctagaaaataaagtaaacgaagtacataatttaaaaatcagcaagaggctgttttgaaaatctaggtgacaattttctttttaaattttacttgatttagcaataaatgaagtaggtggacttgggtcatatcatgaagaaaattcataatatttattacagtaatatctatgtaacaagaacataagttccttagcaaaatattatttcctatattgtgatatatgaaaatcttgatttaaaaatatttcagatatgagactacagatttttttcccatatgtatttatggtttaaaagacaaggaaaaaagcatgcattacataggggaaaatgcaaggaaggaaaaaaaaaacaaaggaaggatagaggaaaggagaaaagaagagagggaagaatgaaggagggagggagagaggatggagaaaggaaacaaggaaggagcaaagaaagggagaaaagcggggaagagggagggagggagaaaaagaacaattaagcatcaactatgcaatgtatactacaggtgcctggaatagaatctagtaagtcggtacaaacagggagaaagaatttcagatgatgacaatttccctatctcatagaaacctgtactagtgtatttatttgttttcattttccagcaagatttttctctatgtccacaagacctgacaggatggcttaatgccctggcaccccactcactgtgtgctgaagagggtgggagctccggcgtccggaacgtcttgatggtggccggcccctcccctcctggggtcagcacttgcacttccagtcggtaaagagtagatggtctcagattgggcactgttaggacataatgatcctaaggggacaacataaaagagcatgctcaccgacaacctttcagagacaacatgcaatgcacagagagcctagaacagtttttcccccactggagaatatcatacacaggcaagtttggttgctttgtaaaggcatagtttaatttatagactatttctcatttgtgggggttctctgccatatggtttcttagcacctcactcaattcttggcagcctaagacacttggcagagttaaaatatgctgaggtgccagttctcagggctcactcctgggattttatttatttttttaattccttaacgtaaaactttcccatggtttaaagtcttcagctgcacatcttgtgatgtgaactcttgatagtccaaatttcagtgaatgagccaactgtttttcttaaaacacagtatctgtcaatgcccataactgaaaatgtttatttttatgccaacatattcttctcaaaactcaataaaacctagtacatttatagaataactactctctaattccatggaatttttccttctgagatttaagttgtgtttctttccctctctgcccctctttttggattttgtaacggtagttggctattctaagggcattttcagagagggtaaaatcccacacatgattttttttttttttttttgaagccaaggaattaagtggcctggaagacaggccaactcattacagcctcgagccaaatttgaagttgcggggaagacggacaaacaacaagcttcttttagctattcctgccctccccaattcaacacttcaaacagggcatgttcacttggaccagagagacatgaggttaacaaagatagaagaaaatggctcaatcacttatatacaagatagggtaaggtcttttcatgagttggctctagccatcaaactttatctagatggcagcttatgctacttcttagctatgcagtcacatttgtgatgtgttaatgcttgcaaaagatacactcagaagaagaaaatgcaaaaataagactcaatagtgcagcacacagaatgacagaggtagccacctctgaaggtcagtaaaaaggagcagtagataccaatgacacagacatagtacaagaggtgggacctacggaaggcaggatctgggactgtgaaataatgctgttgggtaggctgttctgtctgctttccgtagtgacctcagcccaagtcacttgaaacccagtcatgggctgatagagattggccttggccatcttccaagaaaagtgaccggtgatgttcacatcctggacgatgaatgaagcagaaaggttctcaggcttagctagcaccttagaaagaacatgacctgcagcaatgcaagaaggaaaaccaggattaggcgactggagaaggtgtgcccaagggatccattgtaggaattttcagcggccagtctatgggatgatattaatagaagcaatgtgaccttgttctttaaacatgggttcagacaatcacccctttgacatatggggataggttgagtaggaatctcctcactccaactttgtactaaatgcttcttccagtcttttggggatcatttttagaatgctcttttgaagatggaggcaggagagcagtttagaccctggcaagacttaactatttcttaaagaatagcattgactgcagtgagaaggtaaatattaaagctgttagaagagttattaaatccgaagcttttttttttttttttttttttttttttaaaaggtgagatcttgctatgttgcccatgttggtctggaactccagggctcaagtgattctctcatctcagcctctcaaagtactgggatttcaggcatgagccgccatgcctggccaaatccagggcatttaaaagactttttcccactgcaagacagggacattggcaaggagatgggatggaaggtacagatgtgaggtttgccaggttggcatggaaagtgtgtgagtataacccacgcagcaaaggggtgggaaaataatgaaataattatatcaaactttcccaaaacacaagcggtatctaaatgtttgccttcatttccaaagggataacattactatcaaaggacatctttccaagcctgttaggctttaaaataacacattcattcctacatctcttccctccacattgggccatcataacacaacttagaaagagaggcacttttggttttcacggtcttgtgaaacgcagtttgacaaggtttgcaaagcgctgctgacaccgtagacctagatgtagaagtccttcaggtgaaaacgtacctgcttcgcccaggcagccaacaggcttgtggctcttccccttaagagcagagcatggtggagtagtgaagaaaacagcttctgccttggagtgactttttggccgtattggttggacagtcaccttatacttgcaggaaaatgacagatcttgaagaattatgtaattttcctagagcaagagaaagagaattatgctagcaataaatctcattagggattaaaaaacactggcaagaattgaaatcatattccatccaacaaggatgttttcctatatagtgtgtgcaatatggcttttataaaaagtacaaagcacatactgtccacattttgattaatgacaattgtgaaacactcccatggctgcgggatatgccttctagaattaaacagtatcataataattcctcatcaaagcaggctacttctaaggtcgcaatcagcatttttgagttggtagcagtgcaggtagtggtgtaaagctgtaaatacaaatctaacttttttcagttaaaaaaaactaacgcaggcttctctgagacatagaattagtttatatgtaagtttttctgttaaaaaatgatgatattctttagcaatataatttttcccttttttggagtgctgttactgttttctgccataatgttgtgattaaatataaataaaagaaagaggctaaatggtaaggagtcacgggctaagaatataactttatgataatgtcaaaagatgacatttcctgtgataacaggtgtgtatctctgtttctttcatatttggctaaatggcacttatccattctgttttgtatttaccaattcttaatgtatatgtataaaagtgcagatggatagctgggcatggtgactcgtgtcatagtcctagctactcgagaggctgaggtgggaggatcgcttgaactcaggagtttgtgaccagcttggtcaacatagtgagactccatggtttttacgtgtgtgtgtgtgtgtgtgtgtgtgtgtgtgtgtgtttaattattttttaagagaggaaaaaaagtacagatggaatatctctggcactcattggatgatgggtaggggatcttgctagaaagcagcagcgttgacgggaaaaacatgagacaagaattaaaatcaaaactgaggcttgagtgatttacttaagtgaggagtggaagtggctgcaggtgacagagcactgaatgttcaaaagagaccgggagtgacctccaggtgtgctggcccttcatccagatggtgacaggagatggggtgcacccaactctgcagccagttagcacaaacagtgaataggaaacaaatcaatctggacaacgcaagaccaacccaagcccaacccaagcccaagccaaggccaccatgtttctttgggagtctgaattgcttttctttggaaataaatctgctctttacatgggactatactggaatccaaggttagctattaaggatcctgtttcacagatatttcaagattgttttcatattgcataggagacagacatctgcagcagtaagtgaattagtggatgctccattgtagcataaaaacaaattataataattggatctaaaggtttaaaactaaatacagataagttctaaacccctagaaggataatttttcaggagtttgatttttatttctaccagatacattacatctgctcagcaaatagttgttaccactttcagagttcctaaagatgataagcctaggattggggaattgcattgacataagcccagttctgtaaggttctgaggcacacacatataagtaaaacaaaaacctcacccctctgcccacaaaaatattaataattccagcttctgtttattgctttctctgcttttcaaatcgacttccttatttagaatgtctgtttaattattttactgaaggtcacaaacattggagctaatttaaggataaatacaaggagaaacattgctgaacatgagacaaattaagtccagtaaaaaagaaaaagaatctgtgtatttctgaaaatccagtgacttgttttatctcactctcttaaaattatgccagcaggtatggttcttaaaatatcgtgcttgctttagaaaatgttcaaaacaaaaatattctagttacatatcacaaaccaaaacattctatgtttggggccatgtttttggattttttaaactgtcctgaggtatcacatataaactgccatcaaagtgtattatacactgtataataaaatgacctcttaaatattttgtgttagtttgttgattctaatctataattcatgaatgaaccccaaaatatttggaataacattttgggcaatattgacagagttgctatcctcagagagtttaatgttctcttaaagttgaaagtcaaaatattggtgcatgctatacaggacagggagattatttcactaactgagctgatggcagttagggacatggtgctcaatgatagagtcacatagaaatccacttgtaccattacacctttagatcacggtgacatgtcaaaattcagaaaataattcaaagcttttgtccagttaagatgaagcacacacatactcagacatatttccccctgaaatatgggagttctttaagaactgtgtctttagtctctgcactttaggttttgctccatgtggataacagagtaagctcccagtgcaatggtgtgaatggataaaagaatgagtgaatataatgaccattctgctttccacttccatcaagtcattactccatagctgatttgtgggaatgagttatctgtttgacctgtctagtttgtacatcctcctgtctaattatgttcacagatcaagttggcctagagatcatgtccttacgtgggtcatgccagatgatgcctctgatccggttgttctgttgtgggcacacgcttcaggaaaccaccgcacatgatatcggttgacagtgggatctataatgccaaaacacgcaaacaaaaataataggctggatgttacattccaggtagcctggggttcttgaacttgagaggagaaaaggagaggaaatgaaactctacaggtgaccaataaatgcacagtgagccaaaggaggtgagattctgattacttaataattataataattagtaattctgaatacttaatcattaagaacaaagtaagggaaaaaagtaatatactgccaagggaaaacctgtgttgaagtgcaagcactaagtagaaaaaaaaattagtaaattcatagcaaaatgattccaaagatgtcttgagaataacctagccatggtttttacagtaagcaaagccctacaatgaaaggcaacacctagcaacagctctcgtaattcctgttgcaaaagagaatcatcagaagtttctcaatcctacctttttttttgataaagatgagatactattgaatccacacaagaacaaaaacattcccttcacacttgcagaattggctatccacgtttatttcctgttatgtattgccataaagaagttcttttgtccaaaggatagggacgtatgcttcccactctcccttaaccaagcgcatcgtggcatttctgtatggctgatccctactgaaatatgacttggtgttctcaaacacaggccagaagactgaccctttgaacacgtttattcccagggcaagaggaatattttctgtacatttctttactttggacaataaagtggggggaaaaaagataaaatagcggcaagcaactcaatgagtgtgggaaagcagaccttgacagtctcgggtttattaatcaccccagtgtgtccgaggagtgtgaaatggcaccaaatggcaccattttgcaggtgatttaacatcttgtcccccaacatcatgccaagtgtttgatgggagttttcagaggagaaaactctttgatgaaattgggttgatctagtgggaacttcgctttgagcactttggaaccagaaaagaagaactttaaatccgagaaagcaaacagatataaaagtgggcactccgggcatttagctaaaagagaaatcatgtactagaggttttaatttttacatagcagacatcaagagtttattttttaaaaaaagaattataggctatgcacaacgctgaagtcaatcactgagtgtgttcatgttcttccattcaacagcaatgaaataatcacacaggagtggctgctgccctcctgaattttacatagtaatggggccaataataacagagaataaatacaatacatagataagatagatattatgttagaacgtagtaagtccacatataaatacagaaggtggctgggcacggtggttcacgcctgtaatcccagcactttgggaggccgaggcaggcagatcactaggtcaggagtttgagaccagcctggccaacatggtgaaaccccctctctactaacaatacaaaaattagccaggcgtggtggcaggcgcctgtaatcccagctactcgggaggctgaggccagagaatctcttgaaaccggaaggcggatgtttcagtgagccgagatcacgccactgcactccagcctgggcaacaagagcaaaactccgtctcccaccaccccccccccaaaaacaaaaaaacaaaaaaataaaacaaaaaaaaaaccagaaggtaagggcagtagggtggattgacaaaaagtgctgattttatataaggcggctggcgtgtgttcaattctgagtcaggacttgaagaaggtgtagcagtgggtagtggcactgcagagacctgtgggagggtgttctcagccagtcctgtccaacagaactggcgggtgtgatggaaatgttctgtctgtggtaaacactagtcacctgtgcctataaagcatttcacatgtcctctgtttaacagaggaatttaattctttattctgtttcattttaattaatttaaatttaaacagctgaagatggccatggttacaatattgggcagcttaaatgctctaccagcagggaatacacagcacgtgccaaagtgctgacatgagaacggagcatgacggatgactgaaggtctttggtgaagagcagtcaggggacttggggtggctacattacagcaatacaaggaggcttggctgccctggggatcctccatatcctaaaaatcctttacatattttacaatgcaattatattttcataggaggcagcatcaagagtgacacatggggcactccttttgggttccctcccttttgttagccctaaatctcgccatgtctgagttcactgcactttcatcttctctctgtgtcacctccatgaatcacttcattgattcccatggtttgaaaaatttttctgctgacagctcccaaatgtctactttcacctgagctagtcccttgaagagctgatgctccctccttcctctcccatgtggaggctttccaaactcaactttgctgtagctaccatgttgatttctgcacctcaactgctccttgcattcacacttttctttctggctgtaggatgcagaattttgaccccacacataaccttcgaggaaggtgggcttcagcaagcaactccaacagcctcagtgagcctcattccctgtatctgagaataaggatactaattcagccaatgcaataggtttggtgtgttttaaatcagttcatgtactggttttctacagctgctgtgacaaattaccttgagtgtagatgcttaaaacaatataaatgtcttctcttctggaggtctgaaatgggtgtcactggtctaaaatcaaggcaggcctgtactcctttctggaggctccagggaagaatgtattttcatgacttttcaggtttctagaggcttctggaattctttggctggtggtgcccttccaccagcttcaaagtcaacaacactgggctgagtccttcgcaccatgccatctctctgattcttgcactctgcttccctattctacttttaaggacttttgtgattgtattcgtttccacccaaataattaagggtaatatccccatctcaaggttggctttgagtcattgaatggcttttctctgccctctgaataaagacactaatactcagcctggcttccaggtctccactgcctctacatattcatctcatgcagacactcctctcgttcccaatgttttgtttgattctgtggttacttcatgaatccctgtcaaccccatttggttagagctccataactataaagataatgcctatttgctgtcactgttgcataaacaaagatgagcatggtgcctggcaggtgataaacagacagtaaacatttaatgaataaataagtgaacaaaggtataccagttcaaattcacttttatttctctactcattctggcaacagtgaaaataattccttataatctaagacacggaagaaagtgtgaaaagacatgatattacataaggtaattaaaagcaatctgagaaagtaaaatataaattaaacttagattaaaaatgccctgaaagtattgtaaatggcacccccaaatgaccagtatggggactaacaatgcccacactcatttatgtgagttgagctcaattttaacagatcaattcatagatatttgctttgatggaagtcatttatacaaacatcatgtccttagctttatcttgctaattactaaaatcctaagagcttgtattttaggttatgactgcaggtctcaatctgtaactagaatattaaaaatagcatagttcaggccgggcgtggtggctcatgcctgtaatcccagcactttgggaggctgaggtgggtggattgtctgaggtcaggagctcaagagcagcctggccagcatggtgaaaccctgtctctactaaaaatacaaaaattagccaggtatggtggcacatgcttgtaatcccagctactcgggaggctgaggcaggagaatcgcttgaacccgggaagtggatgttgcggtgagctgagatcatgccattgcactccagcctgggcaacaacagtaaaactctgtcttaaaaaaataataataaaataaaataaatagccaaacacttcctgaaaggctgtatctgaaaattctgtgctaaatacccagttgatctggttccttagcttaattccttccacaaataaatgacattacaaagaaagtacctgaaaagtatttttaagtgataaaaaatttacctgtaatatgcttcaactatggttcaaaaattagatgggtctaattttcttttcaaatagatgtaactcacagtgtctggcataaacaaagggctctaaaatttttcattaaatgtgaattcctcagttcgcaaaagtctaatgacaaagaatgatagggttattgacattagagctctgagaaagaggcaatccttgggttctccagaataataattgctttaaaaagaattgtaagtcacagcactagggaagggggcacacacttagagaggtgtcacagaatgccaattccatcagggtagggatttctgtctgcctctttgcagtgttttagcatcggaaatggtgcattgcatacagtaggtgctcagtaaaggttagttgaatgaagtcctctcatggatcaatgcctcatactctatctgtaaacatgatctggtgaaacagaactttctgatgtacaactaaaataagaatttttgagtatcacataggcatttctacttaaaatagaagcatgaatgtttcctctatgtctgagctaacttttcacatttacgttgtagagacacaaagtctagagccagaaaaccatcaagatgcagtggctcatgccttcaaccccagcgttttgggagtctgaggctgaaggatcacctgaggccaggagtttgagaccatcctgggcaacatagcaagaccgcatctctacaaaaaatatattttttaaaaaattagctgggcggccaggcactgtgggtcacgcctgtaatcccagcactttgggaggctgaggtgggtggatctcctgaggttgggagttcgagaccggcctgaccaacatggagaaaccccgtctctactaaaaatacaaaattagccaagcgtggtggtgcctgcctgtaatcccagctacctgggaggctgagacaggagaatcactcaaacccggaaggcagaggttgtggtgagccgagattgcgacattgcactccagcctgggcaacaagagagaaactccaaaaaaaaaaaaaaaaaaaaaagaaaagaagagaaaagaaaattagctgggcatggtggtgcatgtctgtagttccagcttcttgtgaggctgaggcaggaggattgcttgaggccaggagtttgaagttgcagtgagccatgatcatgccactgcactccagcctgggtgacagagcaagaccctgtctctatgacaaaaaaaaaaaaagaaagaaagaaagagagagagagaaaggaaaggaaaggaagggaaaggaaaggaaaagaggagaggagaagaaagagagagggagggagggaggaagaaaggaaaggaaagggaaggaaggaaggaaggaaggaaggaaggcaggcaggcaggcaggcaggccagaaagcttaaaacaattgtttattctattattacacagtaaaaatgaactaatatcaatggagtaataaaattactaacaaaattagctaagtggaattgttttaaaataatgtttgttctacaaatgcaatgttgaaaatatttattttctcccagagcattcactattataacccaactactatgtgtattaagtaaagaaagctaatatttgacgtttaattcatttatctatgaaactacatgctacatcctaataactgaaactgtctctgaaaaattttgagtgaaatgaatagatttgggcttttaggtccctaactccaagtccaaaagcaatattttgcccaccatcacttttaggaaatgtgacataagaacccatttctgtttatgattgagttttgattaatgagcaagattcttttcttcccttatttgccaaaagcattaagtctttttaggttttcaactcagtgtgtccacaattggaaataaattatcattcaaaaatattcagctacttgtcaaggagtttgaaaccactttagatgggtctattgagtttcatacagaggagataatttctcattttacaaagtcaaaaaaatccagaaaatccagccaaagtgtcctttcccatgacagaaactgtgctgatattcacattccgtacagtgctcctatgctagtaatactgagtccatttcaaaggtctcctttcctacatgtgtgataattatgaataagagcatgttttatgaatgtctggggaaactttggtttgggattctgtagatcatgtggtgagtacataaaaggtttctgtaaggaggaaaaatgtggaataagtttgaaacacatactttcctcttcattgttctttggacttcccaaagctttctaccactcccttctatcatgtgttcaacatcatgagctctgctacaatttatatgttcatttggctttcagatttaaaataacaagggaagtgggaatggataaaatttaagaaaaaggactttttggaaaatacgaaactctaattagagcatgagctgttctcagctcctaatagtaagtgtgtgtgtgatccagtggaaatcaactaacatttgcagatcccctgacagtatagtcagtggattgaccatagctccagtcaaatccacgatgctatcacagagctgcctcctgagctacaagtatgtatttctgactgcctatgacattttctggcaatcatgtagttatctcaaattcgacacaccaaaaccaaattctccatatcatggagacatatcccatgaaacatatcataattctactgctcacaatctttgttagtcgaagtactgttagtcattcaagctagaagataaacactccatttagatccatttctctttttctcttcaggcaggtcttaatatccaagtggccatacatcctggctttcctgggagagttacagtctatgtctgttggtggggaataatgtttacaaatgcctccttttattctcaaataaatcccagttcagacaataaattatgtggtcacttgtgtaatactcttacataactcgccaaccttcctcctcctactgctgtctctaattcatgatctgattatttcttgtcttggctactgaaattaaccgacgtgctctctctgaacttttccaatccatattccttgcacacttgcttttgctaacatctctaagtcctgctcagaatttcccctgctacttcacatccctctcctccatgtagaacaaaatccaagcttcctggcataccatataagcttctccatcacttgacattgatctgtctctccagcctcacacagtcacttcctcaatctcaccaatacttgacattcccgatctttctcccagctgcacctcttcatgtcctgggccagaagtgttcatcttccctggccaaaaaaagtaatccagcctttaaaatgtaccttaaactttacctcctctgtgaaaattcctctgcacacaacgtcaaaatctctctgctctcaactacttcagctgtttatccagactgctatgaagaataatgtcttattatgtggcaactgcctaactgcctaagcctcagaactgcaggttccttaaaggtaggaaatctctcttatccgttattgtattcccatcacgtggcacacagcctggcataaagtcggtaatttgtgtccatttgcaaaagaagacaaaaagtgaatggaaatgcattcattgatatctaagttaattcaaaggtgtttttttttgacggtgtctcgctctgtcacccaggctggagtcagtggcgcggtctcggctcactgcaacctctgcctcccgggttcaagcgaatctcctgcctcggtctcccaagtagctgggactacaggcatgcacccccatgcccggctaatttttgtatttttagtagagacggggtttcaccatattggccagactggtctcaaattcctaacctcatgatccgcccgccttggcctcccaaagtgctgggattacaggcgtgagccaccgcgcctggccaattcaaagttttaaaacttcacattttcaaatgaaagttgaacataccatttttggatgtattaaaatactcatctaaagactcttattactgtttgcaatgtttactatatatctaaaggattaacttaaaagaacaaccagacctttcttcccgttcttttttttctatatttcctttgtcactttaattgaaaatgaaaagattctgccaccagctgtcagacacaggatttgtgtaggaaaattaagctctatttgtttttacaccctattattttggtaaagggcttagcgtactcagtagagtcataagtattctgtctagatatttttacacaatgttctttttagattccaaactgtttgggaggatcttcctaaacaaggtaaaagcaaaatgccaaattccatatttttgccattcttttgaagggaatccataccaagtgttttcaagaacttcctgtcacttcaaagaaagttttagcgtgaatatatagagagggcatgagttgaaatggcaaggagcagatgcatggtctacaaaaaaatccacagaacaaatcctgacatgtcactaaagatgtagaatgaatctctgtctcttgagtaagcagtaacactgtaaccacaatagttttgactggaggctacactgtcaactgttgaaggccactgcacagaacattctcttttagaaatatatttgaaatcagttatatctttggaatcaaggttttggccagccacaaagagtgttctctggccagcatggatatgtacttattagatgatggcttaatgttggtctgtagtaggtagcattcctggaggttaactcatttcagaggctggaaatgggtatgaagaaaacagtttgaacactaactgactgcgaggcatttccattagtgaaacaaatcattactgacaaatagaggctagtttacctccgtcacatgagctcatcactcccagcttctcctttgtggcccagggtccaagtcactaaacatcaatcaagtcagcatcacttttggaacccaaatcaaggtcactccttgcctttggatcttgtccctttatcatcaagtccacaatttcatgcatcgtaaactggataatactatggactctaatattgattaataaatattgagacaattctctgcttatggtttctttaaagatttcagtatttgagaaaaccactgatattcttcacatttatttctaactttgagttattcaaagtaatacgtgtgtatatatgtgtacatgtgtgtatatgtgtacatatctatgccaacaaccatgtttcctatttgtcatgcactgaaatcattattgtatgggaatattggtcatattactgcttgctgatacagtgcagtgaaggtgaatctcttttcttctgccaaatttaataagatgcctaagttttgtagcacttgtattgcaaattggacaattaaatcatgtcttaaagcactgctctttgttgttcacaaaggagaaaacattgagagtcagtcctaaagcaacaccaagccttaaaaggctgggctcagaggctctttacgtctgtcctgacatcctgtcctctctctgcactataagcagtgccgtaagaatcctcacactgaaacacctaaggtgtctcctttgtgccaggcaccggtccaaccaatctggatgtgtaatctcatttattccacacaacagacctaggaggtgatctataatgtttcctctagttcatcatgttaatagaacaaagaagaaaaatgtatgatcatttcactagatgaagtaagaatatttgataaaaaccagtatccattaacaacaaaaactttgcaagtaagaagagtaggggattgtattaatctgaccagggatgtcttcaaaaaccttacacttaaacatcatgcctaatagtatcacttttagtcaccattgtactgaaactctcagccagttttaaggcaagggaaaactaaaacatcaaagatatggaaaggaaaatataaaattctcattatttacaaactagatgatggtttttgtagaaaaaatgcaaacaaatcatcagagaaaatgttataattaacaaagtgctaaaacaatattgctggattcacagtcaatatatgaatataaaatatatttataatataccaacaacaaaaatcagaaagtataattgaggaaaaagtatgccatctataataggataaaaataaacacaaataccttggaaaaatcatattaaaaagtatcatactttctatccaatatattataaaacattgttgagacaaaaattttaaacctgaatacagtggcataccatgtttgtagattggaacactcagtatttttaagatgcgaattcttcaaaatcattgacacgtggatgaattcaatctccataaatatctcaggaagtttttgtggaaatcgaaaaattaattcaaatatgtatataaaaatgcaaaaggccaggaatagttgagacaatttgataaagaaataaaaactagaggactatcattagaaatatttataaatctatagtagttaagacagtaaggtattgtcacaacattgcaaaaatatgtcaaagactctatagaaagtccaaaaattaacttgcacatatatgcattatttagggcaaatgaggcactgtagagctttggggaaaatagtcatttaaaaaatatatcatgatgtatcagagaaggagatcagaaggaaaaaaaaaaaagaacactgaccctctacaacaaaaatcaattctgggtaaaagagcttaagaataaaaggtgatatgatttggctatgtccccacccaaatctcatcttgaattgtagctcccataatccccacatgtcatgggaggaacctggtgggaggtaactgaatcatggggacgaggttttcccatgttgttctcatgatagtgagtaagtctcatgagatctgatggttttataaattgcagttctcctggacatgctcttttgcctaccaccacgtaaggtatgcctttgctcctccttcaccttccgcaatgattgtgaggtctccccagccatgtggaactgtgtgtccattaaacctctttttccttataaattacccagtctcaggtattcatagcagtatgaaagtggactaatacaaaagatgaaacagtggacaagaagacaagaaaggagaatatctttgtgacctttgtatgaaaaaggatttcctaaccaggacatagagaatactaaacctaaaggaaacaaaatgatgaattgcttatctctaaaattaagaaccactaagggctgggagcagtgcgcctgtaatcccagcattttgggaggctgaggcagggagatcacctgaggtcaggagttcaagaccagcctggtcaacatggtgaaaccctgtctctactgaaaatacaaaaaattagccgggcatggcggcagccacctttaatcgcagctactctggaggctaagataggagaatcgcttgaacccaggatgcggaccagcctgggcaacaagagtgaaactccatcaaaaaaaaaaaaacccactaagaagaaagttaaaaatgcaagagtggatcagagtggaagaaaatacttacatgaaaacaaatgatggctggatacagtggctcacgcctataatcctagcactttgggaggccaaggcaggcagatcacttgagatcaggagttcaagaccagcctggccaacatggtgaaaccccatatctactaaaaatacaaaaattagctgggcatggtggcacacgcctataatcccagctattcaggaggctgaggcgggagaatcgcttgaacctgggaggcggaggttgcagtgagctgagatcgtgccactgcaccccagactgggcgacagatcaagactgtgtctcaacaaacaaacaccaaatgacttgtatatactatattaaaagcactcatgcaggacagagtagctaaagagttgaaagagtccttcaaaaaagagaaatccaattgtcagtaaaattacaaaaaggtgctcaacttcttggacatcagaaaaatgcgaattcaaataacaatgaggtatcactatgaacataccagaaagggtaaacttacaaagatggaaaataccacatgacagagagaatgtggagcacctggaaccataatcatgccctactggtgagaatgtaaattggtacaaccattttggaaaactattaatgttttctaaagcttgacatactctacggcctaagaatcccacctctatggaagaatatgcgtcaaacaacatgtgttcgtggggcattcacactggtactattcttaatagctccacatctgaataagtaaatctccatccacagctgaaaggatacacagattgatgtatactaaggacatccaggcagcaatataaatgaatgaattgtttcatgcaacagaatgcattggtttctcataaaatgctcatggcaagaagccaaatacaaatagaaattgagtgattccattctgataaatttcaaatacaggcaaaacaaatattgagttttaaaagtcaggatggtggtggttactcttgtatgcttgagatatttactttttcaatagtagatgtttacattttcattttattacattatgtttaaaattttaatattaataaaatgttattttttaaatatgaatatgttgatattttaattaatcaatataatagatcaaatacttttcttatttaatatttataaaattattaactgtaatatagacataatataatcttaatgcaataaatgttgaataaactttaattaacattatagaaataaaatatgttaatattaataataatattattttacttgcagaatggatttcagcagcttgaaagaaaatcctggaataggaaccactccaacaccaatattgcttatggcacatggcccatcaataccttgagtaaaagtgaatttcagaggagtgaggagaattttaaaaacctaactcttgaaacaatctattctgcttatgtttttaagaggcataagagtgataaagataaaagactgtatgttgaataaattctaaaagtaccaccttgataacagaaaaacaaatattctaagactaaaaaaaaaaataaacaaaaagaatttatgctaaagataaatgttcaaacaaatgaaatgaatctatcctaaggataaatgtattgcagccttaattagaaaacagaaattctaaagaactgaaatgtttcattgtactggaataatgacatgtattatgatattaagatatacccatacaaagtagcatttatagaatgttatgaaaaatgcatgacaatatagcagctcaaacaatgttacacagaaatatgtgtgtatgttttaaaaacacactcacacacacacaccctaactgagtgaaagacagatgcatagaaaatttctgaaaggaaacccaccaaagtgctgtttcaggaaatgatattgagataataggtgactttccccccctactttctaaattatttgtattatggatctttaaaaaataataattaataatttataacaaaaattacagctcaaaataatgaatattttgagtgttttggatataacatcagccaatcagccctctgggaaagaaatgaagacaagctaatatccctgaaaggaaaatatttaagcaattgactgttgtagatttcaagatgtgagataaccgtcaactcattcagacttgtgttcaacaaccgtttgccttagtattgatactgtggcttgacatttacttcttcaaaactatctctatattactgtgctgtttaaagcaagtaagaaataagtaagtaatgtttatgtaccttctgtcttcttccagtagactttaacttgcagttggccatcctgatagaagggagctccgacttccagcgggcgagtgggtcgtcgtctttgaaaagggagttgtgtttgaattccaccttttctagttttcacaagctgttcttctacaacaaagtacaacattctaagttacttgttaaaagtaattatagattcctgggcaagatggccaaataggaacagctccattatgcagcttccagcgagaacaacacagaaggcgggtgatttctctatttccaacggaggtaccggctcatctcattaggactggttagacagtgggtgcagcccatggagggcgagcagaagcagggtggggcgttgcctcacccaggaagcacaagtggttggagaactccctcccctagccaagggaagccgtgagtgagggacagtgctatccagcacagataactacgcttttcccactgtcttcgcaattggcagaccaggagattccctcgggtgcctacaccgccaggcccctgagtttcaagtgcaaaactgggaggccatttgggcagacacagagctggctacaggagttttttttttttttttttttttttttttgttgttgttgttgttttagatggagtctcgctctgtcgcccaacaaagatcaaaagagacaaagaaggggaatatataatggtaaagggttcaatgcaacaagaagagctaaaataaatatatatgccaccaatacaggagcatcccgattcataaagcgtgttcttagagacctacaaagacacttagactcccacacaataatagtgggaggttttaacactccattgtcaatattagacagatcaatgagacagaaaattaacaagaacattcaggacttgaactcagctctggaccaagtgcacctaatagacatctacagaactctccaccacaaatcaacagaatatacattcttctcagcaccatatagcacttattctaaaattgaccatgtaattggaagtaaaatattcctcagcaaatgcaaaagaatggaaatcataacaaacagtctctcagaccacagtgcaatcaaattagaactcaggattaagaaagccactcaaaaccatacaactacatggaaactgaacaatatgctcctgaatgactactgggtaaataatgaaattcaggcagaaataaataagttttttgaaaccaatgagaacaaagacacaatgtaccagaatcactgggacacagctaaagcagcgtttagagggaaatttatagcacgaaatgcccacaggagaaagcggggaagatctaaaatcgacaccctaacatcacaattaaaagaactggagaagcaagagcaaacaaattcaaaagccagcagaagacaagaaataactaagatcagaggagaactgaaggagatagagacacaaaaaacccttccaaaaatcaatgaatccagaagctggttttttgaaaacattaacaaaacagatagactactagccagactaataaagaagaaaagagagaagaatcaaatagacacaatattaaatgataaaggggatatcactaatgatcccacagaagtacaaactaccatcagagaatactacaaacacctctatgcaaataaactagaaaatctagaagaaatggataaactcctggacacatacaccctcccaagactaaaccaggaagaagttgaatctctgaataatagcctaccaaccaaaaaaagcccaggaccagacagattcacagctgaattgtaccagagatacaaacaggagctggtatcattccttctaaaactattccaaacaatagaaaaagagggactcctccctaactcattttatgaggtcagcatcatgctgataccaaaacctggcagagatacaacaaaaaaagaaaatttcaggccgatatccctgatgaacattgatgtgaaaatcctcaataaaatactggcaaaccgaatccagcagcacatcagaaagtttatccatcacgatcaagttggcttcatccctgggatgcaaggctggttcaacatacacaatccatcacataaacagaaccaatgacaaaaaacacatgattatctcaatagatgcagaaaaggccttcaataaaattcagcaccgcttcatgcctaaaaactctcaataaactaggtattgatggaacgtatctcaaaataataagagctattgatgacaaacccacagccaatatcatactgaatggggaaaagccagaagcattccctttgaaaactggcacaagacaaggatgccctctctcaccactcctattcaacatagtattggaagttctggccagggcaatcaggcaagagaaagaaataaaggtattcaaataggaagagaggaagtcaaattgtctctgtttgcagatgacatgattgtatatttagaaaaccctatcatctcagcccaaaatctccttaagctgataagcaacttcagcaaagtctcaggatacaaaatcaatgtgcaaaaatcacaagcattcctatacaccaataacagacagagagccaaatcatgagtgaactcccattcacagttgctacaaagacaataaaatacctaggaatccaacttacaagggctgtgaaggacctcttcaaggagaactacaaaccactgctcaaggaaataagagaggacacaaacaaatggaaaaacattccatgcacatggataggaagaatcaatatcgtgaaaatggacatactacccaaagtaatttatagattcaatgctattcccatcaagctaccattgactttctttacagaattagaaaaaactactttaaattttatatggaaccaaaaaagagtccatatagccaagacaatcctaagcaaaaagaacaaagctggaggcatcatgctacctgatttcaaactacactacaaggctacagtaaccaacacagcatggtactggtaacaaaacagatatatagaccaatggaacagaacagaggcctcagaaataacaccacacatctacaaccatctgatctttgacaaacctgacaaaagcaataaggaaaggattccctatttaataaacggtgctgggaaaactgactagccatatgcagaaaactgaaactgggtcccttcctttcaccttatacaaaacttaactcaagatggattaaagatttaaatgttagacctaaaaccataaaaacactagaagaaaacctaggcaataccattcaggacataggcatgggcaaagacttcatgactaaaacaccaaaagcaattgcaacaaaagccaaagttgacaaatgggatctaattaaactaaagagcttctgcacagcaaaagaaactagcatcagagtgaacaggcaactacagaatgggagaaaatttttgcaatctatccatctgtcaaagggctaataatatccagaatctacaggaaacaaataaatttacaagaaaaaaacaaacaactccatcaaaaagtgggcaaaggatatgaacagacacttctcaaaagaagacatttatgcggccaataaacgtatgaaaaaaagctcaccatcactggtcattagagaaatgcaaatcaaaaccacaattagataccatctcatgccagttagaatggcgatcattcaaaagtcaggaaacaacagatgctggagaggatatggagaaataggaaggcttttgcactgttggtgggagtgtaaattagttcaaccattgtggaagacagtgtggcaattcctcaaggatctagaactagaaataccatttgacccagcaatctcattattggatgtatacccaaaggattttaaatcattctactataaaacacatgcacacatatgtttattgcagcactattcacaatagcaaagacttggtgccaacccaaattcccatcaatgatagactggataaagaaaatgtggcatacacaccatggaatactatgtagccatataaaggaatgagttcatgtcttttgcagggacatggatgaagctggaaaccacaattctcagcaaactaacgcaggaacagaaaactaaacaccgaatgttctcactcataagtgggagttgaacaatgagaacacatgagcacagggaggggaacatcacacaccagggcctgttgggggtggggggcaaggggagggacagtgttaggagaaatacctaatgtagatgacgagttgatgggtgcagcacaccaccatggcacatgtatacctatgttaacaaacctgcatgttctgcacatgtatcccacaacttcattattatataacctgatattagtcccagtgtacttcatttcatcctgttatttagtcatattaactgtctgttttttttttaagtaaaaggtggtgtaaccgcatgttctttcatgttcaagttaatgaacccccccttcaaaatccactggaatactaaaagtatattacatataatccccagtatttaatttggtaagtaacatatattcaccaggcttgaaagatgctccaatgtaaataataagtatgaataatatttctcattatagattttttatagttatgaggaaaataaaataatattacaataccatttcgtgaaaaaagtagataggttttcgtggaaaacctatacgtaatgtggaagtatgagcattatacatcaatacttggtgcagggctctaaacggaaatacggttcagctttgtcaaataaatagtaaggagcaaattgcacctactcagttgacaatgccaacttcagcttcatcactcagcaaccaatctgtgtgccattcagattagtgacagacatccaaattctgacagacattgaaatgaaactttaaaatatccagtaaatgaaatgaaatgcaaaggcaacagtacatcaggttgggtaatggaatacaagaacccattcagtaattagctctttctggcagtaattagctctttctgtcagcaattctgagcacttcccaagagccaggcattgagctaggagttgcagagataaagtttttgtacctgagggactcctgaaataccaccaggcaaatctgctctaatgatggtgcaccggcagtgagcttgaccaaaggcatctgcccagtagaagagcatcagtctgaccagccactgtttctgttcttcgaaaaagtggccacaagttttctgaggaatggagccatgggaatataactggtgccatgtgacgtggtattttgtgaagaaaccaggacacttcatgaaagatgaggcgagagtatgttcacatgttcattattaaaagcatgaacttttttttccctattgtccattaaaagtgtattcaacacatattcgttgcaacgtaggacaccacaaaactgaacaagaaggattccaagccctacgtatcccatatccagtggaagatagagatatgctactataaatcaaaacaccattaaatatatctttgaatcaggtagttcaagatttcattcttagcctaggtcatttcttactgtgttgttgtgtagagtcatgatctgactccagttttagtttgctttttattattttgttttaatttagctgtatctttctctcttgtgccattcctaattccccaaacctgctggttttctttgtatctataattctgattgctttagctcagaatggaccagcactacttgtttctgtcaaccttctttgcccatgaaaacttctcagaggctctccctggtgaagattttccagagtgaatcaaaacacaccactcttttgtgttcctgtattttttcagttttaagtaatttttttcttctttaatttgttcctcaaactcaacccagaagtcctctacaaaacagagctcatcctaatcttccttggatggcaactgcctagctcagaaacacgcacatggtagctgcctaatatgtattggatgaaatgaaataaataaaattatgaattgatggctgtttataccaaatatattaccaaatgctcatttgcctggggctattcggggtgttttatttacgtcaatacagtaatcctttaacatgagattcaaacatgttgcagaaagggcaataaacctaatatttgtttttctttggaaacagggtttcccaccattgcccagattggtctcaaacttctggctcaagtgatcctcccacctgagccccctaagtagttagcagtataggtacatgccactaaacctcacttttgactccaggtgtgttcctggggggcttggttggggtggtgaattttgacactaatttatattcatagagccatcctatgaaattaagcaggggtcagtaaactaaacttttcttaaatggccagatagtaaatatttttggttctgtgcatcatatggtaaatgattttggttttgcagactggtctctctcccaactactcaattactgttgtaccccccaaacagccggacatgatatataaatgacatgtaagcaaatgtgaccctgtgccaataaagtcttatttacaaaaccaggagggggctggatttggcctgtgggccatagtttgcagacccctgagaaagaggaattggtatacactgaagacgaaaaaaccagcgctcaaaaatactaagaattgtatccagtttcacataattcaaagagtgaaggtgaaatttaatcccagggccatcccatgccaaacttctgtttccatcaccatgtactgagtcttacagagcacccatttatatggtttaataattaagacaccaaaaatttccttaggccccaaatttctccctcatccactcactgaatttagaggttgcatacatagaaattctgccctttgatgcaagacttttctgctttctgaatttcaaatagccctctgagagataaaagggtaagctgtgttgattttatgcctataaacaatgtgttatcgaaactcttctaataaaagcagtgaggtttgcattcttgggcaggtgagaggaagacagaaagatgagatggagagaacatgcccaacctgcggtaagacaagatcagtcaaggaaagctgtggaccccagaagataatctacatcaactcaatttttcctgacactggcatgcccaatgaattgtctatccaacggaccagatgaaaggaaaataaaaacgcacatttgttagattcgcatttaggctattttagcttaaagagttcaaatcaatgtgtggataactgagaatcatttattttattttattttattttaattttttttgagacggagtctcgctttgtcacccaggctcgagtgcagtggtgcgatctcggctcactgcaagctctgcctcccgagttcatgccattctcctgcctcagcctccagagtagctgggactacaggcgctcaccaccatgcccggctaattttttttttttttttttttttgtatttttagtagagatggggtttcaccatgttagccaggatggtctcgatctcctgaccttgtgatccacccgactcggcctcccaaagtgctgggattacaggcgtgagccaccgcgcccagccggctaattttttttaagagacacagtctcactatgttgcccaggctggtttccaactcctggcctcaagcaatcctcccaccttgacctcccaaattgctgggattataggcatgagctactgtgcccagccaggatctaagagtttcacaaacccatttatgtttctaataatctgtgataatattgagaactcaccagcagataactaggacagataatcagtttagatagatactgtgtttagatactaggtttaagctcaatgtcaatcttgtcttcctacttgctttatatcctaggcaaactttttctttctttctttcttttttttgttttttaaacagagtctcactctgtcgcccaagctgtagtggagtgcactggcatgatctcggctcactgcaacctccgcctcccgggttcaagccattctcgtgcctcagcctcctgagtagctgggactacaggcacgcatcaccatggccggctaatttttgtatttttagtagagatggggttttaccatgttggccaggctggtcttgaactcctgacctcaagtgatctgcccatcttggcctcccaaagtgctgggattacaggcgtgagctaccgcgcccagccctaggcaaactttagtatttaattatagatgtaaaaacatatttttatatatcttaagattgaaccattgttgctttattaaaatgattcaagaagagaaatccaccaacaattagtgttgctgacacacgccatgggtaaaaaacagataaggtgcatactacaatgctagcagtatgaccctgactttataagaatgtctcctccactttcagtaataagcaaaaatggaatatcatatctacaatattctgaaaaagttatgatgtctgatttacactcgatagtcatagaaattaagaaaataaaatatgtacactatttttcaaagatccaagttttgattaattttatagatcatcaagagattcagagtattttctctcccatctattcttgttctggagagccagaaaataattccagttccatgaggcaactataaaacatttggaacctgtcaaacttgaaaatattcctcctgccttcaaagaagcaagctacctttccattaaagacaatgttatatcatacttccttcaagggattgtttcataaaactgcatgaacattcagccttcacttgaatagaaatgtttatcattaaaacacctagcagcctgcagacctggaaaaatataattcaaaaagtaatttatatagtgacatttactactctccttcctataaaatgtaatttcccttgcttatactgtaacgttgtaattattctttacttctagttggttcatgatgaaatatataatgttcttataaaagtcacagactagtgtttatgagattatatatcaacactgggatataaaatcctgacaaacattcaactgtatcctacataatccgttgaaaagtcaatctcttctgtggaatcacctgagacccaaacaatgtgtgttactataggtactttgcactatgacttcttttttcttacttttcttttattccttttctaatctatgtaagaggaatcagtcctgagaataaagtggtctttgataggttaactaccatatctcttaattaactaccctatcttttaattggtcagctaaagtattacctagttttaaaagataattagcaaaggaccttaacacagggaatcaaccggtcaaatagatttctttcatttaactgcctgttttgttcatttaactgccataattctagtgtctccccacctggctaaaaactctcactggtaaagataattcctttggaatagtcaaccaagtgaaaacacaaactcttggaggacacagttaaaatatgcaaatggcttgtaaaagatgtccaaccttggttgttccaagatgacaccaaaagccatttctttctctcttcccctttagtatttatgaccgtagcagatgaaagcttaagaaagctgtcgtgttagagtgtggcacagagctggttgaatggaaagacagttgcattcagctgagttgcagtcaatttactgagctcttactatgttcctggaaaattcaagaaacctgtgggtcctgaaataattgcaggacctagaaacaaactgaagtgaacagaaagtggtaaaaggaagtctcccaagtttctggtcagtagtaacctcaatggagaccagagatacatgagaacatcgagctttgtaagtggagggagtgagttcaatgtggagtatgttgaggttgagatgcctgtgtgacattcagatacagggaatgacaggctacagacatctggtattagtggagaaatcaaggctggagctgagtcattgagaatggaccatgagtaggtagtgactaagttgtcagagcagataaggtagaaccctggagagctccaatgtccaagagccggatggaggcaggagatcctacaaggaaactgaggtatgagaaaaattaagacatctgggagtcaaacatacaagggtcaagatgtaacaatggggaaagtgtagttaaacaaggacaaactcatcagaaatggtcaataaaattacaatggaaaacatccatcagacttagaaattagcaggggcagatttggtggaaaagtgagattgaaaaatagattgcagaaacttgagaaaaaatgtggaaaggagaaagataagatggtagctagaatgaaaccagcatcaatgaaaggtttgctttagaactggaagctgagcagatcaagccagtggagaggaataggctgaggttgtaggcaaatgagggaataactaattaacttggtttcaaaaatatttttgttgccgtgtttatatgccagggattatgacggatactgtgaccacatatgtagataatccatggtctctgatgtagatgagatttgacttcagtggatgcaggtatctgagttggggaggaatgggtctagaaactgcatggtgaagtccaccacatgcagaaggaagggtgcctccaccttagaatacagaagacaggagaagataaacatggacataagaatagatatgtttatatttatggggaaccgcatggcttactgagaggaagggatttagactagactgtgtactccatgtaatagatatgtttatatttatggggaaccgcatggcttactgagaggaagggatttagggactgtgcactccatgtgcaatgtggctcaaaggagagaaaaaggtttataatcatacttgagagggtagcagaagaagctaattaaagaatatctccctgagttacagggttgtgtggggatgccccaggaagggtgaagaagctgtggatatgctacagagatccagggttccataaaagttttgtctgtgggctggaccatgacaaggctctagataatgtaacctcaacaaggacaagttgaagtcggactttttttctccttgcttttggttctggaaattaacagatattaaattatgggaatttgcaatcccataccagtttctaatggggaaagaatgttgtttattggaagaaccaggagactaaaagacatgcttattttatacaatagatgaaatctccaccaccagtagagaaagacagctcttgcatgaagctgaagtttaaaggattttggcctgagaagggggttggtaaggaatatagaagaatatagtgaaggatgaagttttggggaaagagagaattgaagataactaggtagctgtcttgagagtggaactccaaaaagagagagatctgtaactacgctgatattttctaaagaaaactttgactgctctttacaaagaatagatatttaagaaagagcagaaacataatactaattaggagactatttcaatttataggaaagaaaagacaatagcgtgaacaagcgaaagaactggacagattccatatggaatttaaaattagagacaaaaggactttctgaagaattgaatttctggagagaaaaaacagagaaaaatgaagaatgacttctgcatgtttggcttgagcaaaagggtgaatgttggtgccatttactgagataggcgagcccaggagaggaacaggtatgggcgaaaatccagagcttgtgtttgaacgttttatttgaaatatctgcaagccatccaaggggaggtgctaagtgggtggctgaatgcaggactctggagttcaaagagtggtcagggtgggagggcagggagtcattagcacacagatggtggttaaatccttgcaactcaatgagacctccaggggagagaccagtggcccatccaccttcattctttcctcacgctgagttctctgcccatgcaatgcgcttctctaactctctacactcatccacgctgctgcgtttgtgtggaatgatgtccattccttgtgggcctgcagatcgctcactcttcaggacttcatgagggatgatgtgactctcattccccaactccatgttggtcatttctgcttccactgtttcctgtagttctgtctgtatgcaacacacagatctttgttattattttacatatttatctcccaaattcaaaattaggcacttttaaggcagaaaccaaaatacatcatcgtgctaggaataatgtatgtgtgtgtatatatgtgtgtgtgtgtgtgtgtatgagtatgtatgtgtgtatagttatgtgcgtgtttgtgtatatttgtagacacatgtgtatatgtatgcatatgtgtacatatatacctatgtgcatactatttatagaaaattatggaacatattgctatacagtacgtatatatagtgtatatagtgtattacagtatatagtgtatatataatatagtattcctggcattagacacagtgatgtcataattcataggcacacaatttcaatgcgatgggtagatggatgaatggattaaaaatgaatgaggttactaaacatatttccatgagaacttttaggtaaaatttatattgtaccgagactcacataaaaattgaccatttcaagtccatttaatctccaaagagactatttctcaaacagatagaaatctctgtttctggaccattttttgaagcattatttcaaacaaacctgcccatttggatcctacgttttcccaggggtggaaggtaattatgagcaacccctgtgtctcactctgcaggaccagcattgcctttcctaaattcagacaaatgtttaacacattcttcttctccttctgaacaaggcccactgtcctgatcaaaggcagctatgatgacggggtcctgctagcctaaaaaatcaacatcggaggagcccctgcgacaaacgcctcctccctcctactctcatttaatttgtcccagtttcctgaaaccttgctaggagcccctgcatggcagttctaaccggtatcgacgtttgaacaaagccagaaacatcaagtaacttattctctaagatatgagtgtcatataagaaagactcttctattgttttgctcagttcccagcaaacatactaacatactaggtaagaaaaaaagaaacaaggaaaagcaatatgagaatgatttagtaacttcactcaatggagtattaagtaacctttcaagcagtaattatgaccactgtgtagtactaggaaaaacaggcatgccacaccactttttgtgccccctatccactcgcgtacatacaaacacattattctcagtactatgatttattttggtctctgccttcaaaagtgcccaactttgatttgggagataaatatgtaaaacaattgcacaaaaataagtgtattgtatacagaactagagaaacactgtaatcccagcactttgggaggccgaggcaggtggaccacctgaggtcaggagctcgaggccagcctggccaacatggtgaaaccctgtctctactaaaaatacagaaattagccaggcatggtggtgcacgcctgtaatcccagctactcaggagactgaggcaggagaaccgcttgaacccgggaggcaaaggttgcagtgagctgagatcacgccattgcactccagcctgggtgacagagctagactctgtctcaaaaataccaaacaaaacaaaacaaaacaaaacaacaacaacaacaattacagaaacagtggaagcagaaataacatcaagttataacagtttaactgtacgtaatctcctgaaaaacaagtatgcagaatgcatatgtgcacgtcatgtaaacataaaaacagtcaatctgttaaaatgagacacaataagttttcttaaatttccattacaacaccaaaattgcacctacaatagataaaaaccataagaaagaattcaaaagtcaaactgtttcgtatgtcgtagtttaaatactttagtcacatgcatgtgggtaagaagatttgccatataattattccaaatcaaaaactcactctccctccattgtgccttgttgtgatatggcgcccatcatgtcacaatcatcttgaaaaacatgacacagtcacttactgttgttggttgcatgtgtcgatgtgaagtgaagggacacctttgcactcttcagccgtgtctgtccccagtacgttatggcttgcaattccacaacatagtcacagtctggctggagtttctccaggatcacagaattttgaaactagaaattaagagaatatacccaaaatgcgttacaaaccttccacgtctctcatcttcattgcaaaatctcgtgtgtcattatgaagcatgccaacttctgatttcttttaccaacttttctatatctttgggatctgaaaattcagttttactactgatcaaaataaacttcaggccaggtgcggtggctcctgactgcaatcccagcactttgggagcccgaggtgggaggatcgcttgagcccaggagtttgagactacctgggcaacatagcaagactgtctctacaaaaaaaattaattgggcatggtggtgtgcacttgtagttccagctactcaggaggctgaggtgagaagattgaacccaggaggttgtggctgcagtgagctgtgatcgcaccactgcactccagcctgggcaacagagtgagaccctgtctcaaaaaatataatgaaataaaaaataaaaataaacttcatagaaaggccaaatgtattttgaaatactgtttctaaaccaattattggtctcagataccatggaaataaatcattctgagccctcgccactctgagacaccacctctcgaaggaaagggagctgtttataataaagtaacagagatctatgttgccacatacatggaaaaattatgaattggcactaattgcaattctttgatatctgttctaaattttctaggagcaaatttccaccaaaagctatacaaaagaaaaattaacttgacaaaatgcttcaaggtgcttcattattttctgtcataatgtattgggcagggggctggagggtgggacctgtcagcatttcatcatgtcactttttgctctagattcctaagtgattccccaatttcagctcttccagctcatgcaataagtgtgcactaccattatcatttgtagcaaaatccttcaatataaaaaatggaactgtcataaaatttcataaaaataaagtggggctgggcgtggtggctcacgcctgtaatcccagcactttgggaggccaaggtgggcggatcacgaggtcaggagatagagatcatcctggctaacatggtgaaaccctgtctctactaaaaatacaaaaaattagctgggtgtggtggcgggcgcctgtagtcccagctactcgggaggctgaggcaggagaatggcgtgaacccgggaggcggagcttgcagtgagccgagattgctccactgcactccagtctgagagacagagcgagactccctctcaaaaataaataaataaagttaaaatagtataatggctaaatatcaatgataccaactttttgaggcatgttttataattctgaagagcacagatattgaaatctttagccttgctatcttttcatttctaaacatttatttatggaattcaactttataagtgataggaaaaggtatttatgtaaattttatgacaagataaaggaatgtatactaaaaggaatccaaataactatttttatgcagtaagcatttcaaataatacaagatgcttgttatcataagaatctcattgcagaaaatggttcaatgaagattttatttcttggcatctgacggataaaccactccagatccttttaatcaatgagaagaacatattgtgagacgtggccttcctaagctgttactgctcagtgattagattacagacggaaacacttcgcaacagaaaagccatgaacatccactcttccatttacaaggatctctctctctcaaaaaaaaaaaaaaaaaacttaaaagtaaagtacattttgcataatatcattttctatggccagacaggtaagatggggatcatttaaactgttcctttgatttccagagttctgactgacatttagataggagtaggtcaatggtctaaatgcaaatgcttctgcctaaaatataaaaggcaaaacagccggcatgcccctgcattctgtgaacttcctcggtagaaatgaatgggagggaagctttcctgcatccatggcatctctcagtttagcagaggcctcttttcaggccagttgccttgagttgaaataccctctgtgggaataacaatccttcctccagttcccactcaccccatccgtagtctttctccgcttcttctttgttgggacaagagacttactgctgaccatccagctccaaaagaccttgtaatgatgcacagggatgtccggctcctcggggagatcccaaactatagtgacggtcacactcccatcactgttgacggtggagttggccagccggaggttagccggtgctggtggggcagatggatctgaaatcccagtacaaagacacatcatatgactccacaaaactaacatctttggacatgtaatgactacatggtcaacacgtgaagcattgctttttatagatagaaaagctgaaaacgggggtggaggggcatggtggctcatgtctgcaatcccagcactttgcaaggctgaggctggcagatatcttgagctcaggagtttgaggacagcctgggcaacatagtgaaaccctgtctctacaaaatttaaaaaattagctgggcagggtggtgcatgcctgtggtcccagctactcaggaagctgaggcggaaggagcgcttgaacccgggaggtcaaggctgcagtgagccgcgattagcaccactgcataccagcctgcgcaagagaatgagacactgtctcaaaaaaaaaaaaaaaaagtaaaagaaaggcaaagctgaaaacaagcagttaagtaagatctccttgttaagcctcaaattaaaagatagagtattaaacagtaagataaatttgtttggtccaaatttgtaatacagaaggatcgttttaggcatttccataccacggcaacccagccaaatttttactgtgctgaaattgacatattttagtaaaatatagtacaattcaatgtgggtgaattgacattaaataggtaagcaacaaagaatcaccttttaacactctgaaaagaaaaagaaattcagctcataaaagcaattgttttcatcttcgtgccctgtagctagcaattcttgcatcagttaagaacaataaagggaaatcagaaaagaaaaaaaatataaaaacctgcaccattttttatccacattgcacactggatgacttatggatagcattcatttttgtgattgtaccatttctggtttgtcttattaacaaaaaccttctcagctgtcaagagaaagatgaggtgctggaattaccacctcacaaatctccactgaaaatacatatatgaagaagattaaatataccaaagctggagggtctttacttcattttctattacaaattgagcaagtggagatgctgctcaccaccagtgatttacagagggtttcatttcaagatgccatcacgggaagatgctgtcaataattctaattatagcaccatctgtgttggaggctcaaaaaagtaatatctaacttgatatacatgaagaagactggagaaaaaaaatccttgtttttattctcagtcatttgtggttttggaatgatggaaacataacttattttttgaaatttcttgctttcctctatgatatatcatgtctggacatttagttaggttagttcctttattttctaaaataagaaagcttcatagtattttttaggtaagaggctaattgaaagcatattatgtgatactgctagtcaagtcattttttttttaaattaacttttattttcagttccagggtacatgtgcaggcttgttacagaggtaaatatgtgccatggtggtttgctgcacaaatcaacccatcacctaggtattaagcccagcaaccatttagctgttcttcctgatgctctacctccccacctcccccaagcaggccctggtgtgtgttgctcccctccatgtgtccatgtgttctcatccttcggctcccacttagaactgagagcatgcagtctttcgttttctgttcctgcattagtttgctgaggataatggcttccagctccatccatgtccctgcaaaggacatgatcttgttccttttcatggctgcatagtattccatggtggatatgttccacattttctttatccagtctactgttgatgggcatttgggttcattccatgtctttgctattgtgaatagtgctgcaatgtacacaagtgtgcatgcatctttataatagaatgatttatattcctttgggtatataaccagtaatgagattgctggatcaaatggtatttctgagtcaagtcattctcaatcaacatcaggaatctctggaatgtccaagacttatactgggatatgctgattccctgagtgcaggtgggacccaggattatgtatatcttatatgaaacacacaggtaatatgaggtagatgacctgcaggtcaaaagtactgcatcaggtggctcctatgaggtctgaacatcacatatgtaaggaggaaatgtatttttcctgtcgttattggaatgggaagcaccccaatatggaggtctggcagagccatgtgaggactcccccagtcatcaatattcacaacactgctgatcacttccttctctaagaaatgcaggcttcatttggtgttcaggacactactctactggatttttttttttttttttttttgagacagagtctcaccctgtcacccaggctggagtgcaatggtgtgatcttggctcgctgcaacctctgcccgcctgcctagtttaagagattctcccaccttggcctcccaagtagctggcattacaggcacctgccatcatgcctggctaatttttgtatttttgtagagatggggtttcaccatgtttgccaggctggtcttgaactcctgacatcaggtgatccactcgccttggcctcccaaagtgctgggattacagatgtgagccaccacgcctggtctctactggattttcattcagtttcaacagaagctatttttcagccccatgctccatgatccttaacatctcataatctctagacaggagagtgttctgcatctgaattcaggggcctctctcttctcatctacactcactctctagggatctcatcaggtgtcacagttttaaaaaaatctttgtgctgataactttcaaattgatatctttaacatagactatgctcctgaatgcagatccaatcattcaaatatcaatactcaaaaaataccttccagtagctccacttggaggtctcagaggcatttcaaaactaatgtgtcccaaagaaaaatcatgatccctatgcacagcccaccaccaacacatatcctaccacacacagcccaccactgacacccccatctcagtacatgggaattgctctttccagttgctctggccccaacccttgaagtcatacatttattttccactcatatctcttgagcaaattgtgttagcactaccttcaaagtgtaacaggaatttaactgccttttaccacttccaatgccctgggccaagtgccaagggctctccactgcctccctagaggtttttctgaatacagcagtctgatgattctatactgccagaccatgtcactcctgtgcacagaatctccttacttagggtaaaaacccaggagtctcctgaatgccttgcaacccgtgcctcagttacctcccagagcacctttcattttatcacctccacccctcagcccagccacactggttcccatgctgtttcttggagaggaaaaccgcgatgctactgaggcttttcctctccctttgcctaaacgctttccctgatgtctccacggctggctcctttcctgctgcaggtggtgaccctatttaaaatagctacatatgctttgctccatttaccaaaaaaaaaaaaaaaaagtcaccatgattatgccttgctttattattctccaagcccttattactaactgttatggtaaatattgagtgtcaacttgattggattgaaggatgcaaagtgttgatcttgggtatgtctgtgagggtgctgccatggagattaacatttgagtcactggactggaaaaggcagaccctccctcaatctgggtgggcaccattccaatcagctgccagtgcagccagaataaaagcagggagaagaatgtggaaattttagactggtttagtcttctggcctacatcttcctcctgtgctggatgcttcctgccctcgaacatcagactccaagttcttcagctttgggactcagacctttgaacacagaccgaagggctgcactgtcggcttccctactttggagttttggggacttggactggcttccttgctccttagcttgcagatggcctattgtgggaactcatcttgggattgtgtgagtcaatactccttagtaaactcccctttatatatacatctatcctattagttctgtccctctagagaaccgtgactaatacacaaactgacttattaggtaccttgtttgctgtctgcttctactcacgataatgaaagctccctgagaggaggaatgtttgcttgttttttcacatctgtatctccagagtccagaagagcacctagcacacagtatgtgctcagtaagcaattgctgaatgaataaatgaaggacaggcttctaaacgttagctttgatttgtaatgtgatatttcagtttcaggttcaaactctgtcaatcagaattgctagatcacaagatcctaaagtgaattgcaaaatcaaaggagtgttcttcccagtttgaaataaaataattaaagcaacacctcttcctctggtgtaggaatcaatccttaacctacaaaaggtagttaccaacctttctgggagggaacctagtttacaactgaatcgtcacttcaaggcaagagaagaattaaaatgtgtgaaaataacagccgttcgtgttctcggcaatgcacctgaatgtctatatgctgaaaataagtagtcacatgaatattgcagatattctaggctcagaaggaaaagctcaaaataatctcctcttctaaagaaactctaacatttaagaaggtcactgaatttgatcatcttctttagtttatgttattcattacatcatttcctgccctggaaaatttttcttagatgttatcataataatctagaataacatcatctattttatgaaacattatgaaacatgaaacaacacaatttatgaaaacaacatttgagaaaacaatgcattaaaagatatgaattaataatattttctttacatttttctcaaaaggaaggcccattttgaatttacaataccaaaatggcaaacttccattaccaagataaggtactcccatctctttctcccccaaaataatcaccataaaactgtaaaaccaggtcagacatggtgacccacgtctgtaatcttagtgctttgggaagctgaggcaggaggattgtttgaggccaggagctcaagaccagcctaggcaatagagaaagaccctgtctctacagaaaaaaaaattttaaattagctggggcatggtgttgtgtgcctgttgtcctagctactcaggaggctgaggcaggagaactgctttagtctgggagttcaaggctacagtgaggtacgactgcaccactgcattccagcctggatgacagagtgagattctggctcttaaaaaaacaagaacaaaaagaaaacaaaaccaaaagagagtggcagcgatcacctgtttgttgccgtgattctcctctgtaaaccagccattcatttatccatttattcactatggggttcaggtgagacagggtcaatccagtttctctaatctgaagcattttactcagtcctaacaagtttctatatctaagtcattctctgccttgagaattggttccctacgttatgaagcaaggtgtattcattcggctgaattatacagaatgttttctttcattatgcatgatattttaattgttttagaattttgaaatgtagttggagatttccatgtgaaatttatatatatatatacacacacacacacacacacacatacacacacacacacacacacacacacatatatagatgtacatatgcataaatagacagtggctgatgagagccagagagtcagagagggaaactctatacgttattataaagccctaaggaattttacaacttatttcacctttttttaactggggagggttttaggggtcagagaggtaaagatatatgtccaaggtcattcacatcattgatggcagaacaaggagcgtgagaacaaaaaggaaaggagaaaaacggggttgaaggtctaacaatacacacctctacatgccacactctacatatatattccaccatcaaaataagggacaatatccctacagaatgtaaaaattcaaagccttttaatgggaaaagtgtctgttacaataggctagtgcaggcattgataggccttttctggaaagggccagatagtaaagattttaggctttgcggaccatatggtctccgttacaatcactcaactctgccctcatagctcaaaagcagccacagacaatatgtaaacaaatgagtgtggctatgttccaataaaactttatttgcaaaaccaggttgcaggccaaatttggaccctgggccacagactgctctcccctagttgggagaatttcaaaaagtgtgaaaccattaggtttaggaaactcgacatgagcactgtttatccctaattttacaaacatacagctgcattttgtctattaaatgttaacattattgttcttattttagagatggggaaattgaggatcacagtttgattcactacttcaagagcagagtttgatttactacctcttcaagtgagaggatgggaggcacaccacaagaccagtgctctcctaacccttcctctgagtctcaaatctgggcattttcccccagctcacttctctttctgtttgatgccaactccctccttatgatcttcacaattatctgcagaaacacactgcagagagcaagcacattttcagagataactgaaataggaaggctgtattagctccttctacgctatacaattagtgtgattaccaacgtaaaatatgctaaatatttagcatgtatacccaatttcagccttggggaaaaatagttccttttattgatgatcacatgtggtgctttcaggagagaaagatggaacatttggatttcagaaagataaatttcaggtttcatcacttaacctcttgtgtttcatgccacaaacaggcaaagtaacaagcacgaaggtttgacacaatggaaagactttgagcctatgttgggtaaagtgacaataaaatcacttatcacccttggagaaatgcaggcctattattgcactgacatgaatctcatgggaaaagaccacttctgcttgtcccagcagaaatgccatcactttttctgaggcaggctcctctaggtttaagacaacactatttgttaaatacagaaacccatgaggccataaagagagcaacgattatagatcatcataaagaaacatgcacatgtgcacatggagaacaatacctatttcaagaaaatgaatgttgattttacttatttcatttctaccaataatgtctatagattaaacttcgcactgaaacgcatcataagaacacctcataaggtatacttatggtatatacttgatgtaactttggtcaagtgcagttatattttaaaaacaataatataactgtgtcacaaagttttcaactaaatagaagtttgcttctaataatatttaaacctttttttttctttccagacttggcagttggggtagtgttccttctcccttaaaaaaaaaaaaaaacttagcaaagctgctgaagctacactgcaggcaaatttccaactattaaatagtttcaagacatatgtacagccaagccttttgcccattggaaatggcacatcccgagcagctgtggaacagagtaaaaagtcatgggtccccacggggcaacagggaactttattaccatcagtgatgtctgctctagttttactgacactctgtaatgcatgcatggaataacatccagtgtgatacttatatgctgtgaaaacaatgctgtctgcttccttttcctttgtaatgtatcctatgcacatggagaaataaggagaaaaagatggatgaagaacttggaatttagagggaaatgaatataattactaaaagataatatgctaggttaaggataatttaagttggatttttatgtttcttcataagatcccttaaaagtgtgttattttgtgatgtcaaattgatattgactaatttcaaatgaacaaacatgcttgcccgcttttggcaacatatcaaaaaaaatgaatttggattttgccttatacaatccacaaaatcagaactcttccttcttttactacccatattgacacatagatgtagtcacagtagccagaaacaaacacattatttcccaaattcagcaaactggtaaatactattttgtaataggtagtagctacttagcaatatatatttccaatcctaagcatgcaatattctgtatttttgtattttgtaattttgtatttactttatttgtaaaaatacgaatgtttatttgtaaaataactatttttactcatttgataaatatcagcaatatcaaggaaaggttaaacaccaacttactgaaaaagataagcaactgcaacatggaacccaaaggtgtttttatatttgtaaccctgactccaaattggtcattcccaaaatctgggctctctgttggttagacattagtggtcttctcattccaagaagtgaacaataatgtaaagctcgtcagattttgggaaatgagagaggtgaaaataaaagaaactagaaagggatgcctgtgtctgattattaactttgtaccatagaggaagaagattaggaatatttagtaatgtgggaattcctttcatgatttcatcacattttattcatgaaactattaatatatttattttaaaccgtaattcaaaatgtattagatccactctgtaacaggaatcacgctgatgttgagttaaacaagaggtaaacaacagatgttttcagggtcccaccctgactttcttgtgctaggctgtttcagggcacaccagctcaacttctgaatgccctcccacacctcctcacctaaggctgtgtctgggctcagagcaagctccgccagcatgcagaccagatacgctaggaacagctgcagacaaagactgacttgaacacccttaacccccctccagcgaggagttctgaggtgtgtgtgcttcacgctagctccctgagtgccccgtggagaggaagcttaggttgcctatggtaaataattcaccctttactgtattccttctacaccctgtcctacttcccttcctacctaccacattcttggatcacttcctaagtaaactgctcacactcaaagccttcacttggatcaggttctgaaggtgtctgatctttgatgggcaatctctatttgttgaaatctgtgtttcaaagcagcaaatatcaacttatgtagcaatatgcagacatatcaacatctcgtgctcagaggtttcatgttgtttgttccaaatggaatgggatagaaaactttaggtagacccccaggaatgacctgtgaaggtaacttactatgtgcaaagatgcagtcccacattctaaataaagagacaaaaagtagaaatgagcactaggcattaatctattaaactattatgcatctttaatttcaaagccaatttcccatctcaagtaccaggaagaaatacagtatttaagtaggcaaatataaaaattatccaaaactcttaaaaaattaatgattttgcccatcctatatttatgcattttttctgggaggggtaagagttagcaataaaaatactcagaaatggtattccccaggaaaaggaaaagcatgaaactaatttactaatctatgaataacttagaattttctataaaaatagttaatgttgagttaggtctaagttatgggaaaataaatgagttaagaagaaattaaatagtagtcaatccattttgccaaacacggactaattttgtgttttaaaataactataaagaagataaggacaagaagtttggcttttccatgaaaatcagttttatagtccatgaatcctatgcagtgagcctaaactaactggaactcattttacctatttttgctgtttaattttacttttatttgctgagatattcatggtagatgaaaaaaataaaaataaaaacccttcctgctttccttgacccagccttaagttatcaacactgtctctctacccaaaccaaatacactagataattgcttactccttgcacagactactaccttggaagtggtgactgttttttaaaagtaattttaaaccactggaagactggcacagtttcaattctggagcaaacagggataaatgggcatttattgaatgaaaatgcaccattttttgaaacaccacggtcattgcagttattatgaaaatgttgttctatctctcacgttgacaaatacacctgatatggtttggctgtgtccccaccgaaatctcaacttgaattgtatctcccagaattcccacatgttgtgggagggacccagggggaggtaattgaatcatgggggcaggtctttctcgtgctattctcgtgatagtgaataagtctcatgagatctgatgggtttatcaggggtttctgcttttgcttcttcctcattttctcttgctgccaccatgtaagaagagtcttttgcctcccaccatgattctgaggcctccccagccatgtggaactctaagtccaattaagccttttttgttcccagttttgggtatgtctttatcagcagcatgaaaacagactaatacaacacccaaaatttacatttccatatgtctcaatttgaggtgcatcccagatgttagttcttgcagtcttacaaaccaaaaatgtaagcactgaattcatagtagattccattatgttttccgtaaagatgcatcacagaattatgggagtttaacaaatcagtaaaacggtggaagacactccctccaggatatgtctaaaggagacttaaccagtacactaacaagatgctgccacatctttccctacctttctcaagctcatcaaatgtagaaaagagcctcactgcgaaaaaatgtctttaacaacttttttgaaatatgtaacttccataccataaaattgtctcatcttaagtgctcactgacattcttatatttactgtgttgtgtaactatcaccatcactgggttctagaatgagtccatcaacccaaaaagattgatccttcatcccttactgagaaaatttaaaggtagaaacaacaacacaacattttctgtctttaccttctctttttattactcttgtttcatttcctcatatattgaacaaggatttgttgggcagctactatgtgtcaggtactgttctaggcagtgggaataagaagtaaaaaagaaaacacatctggtcttatgaaacacagaaacagacacacacattcatcctaattgagtgcaaggagaaacagtgcacaagattaacaagcaaaatactaaggcagggtagacagtcataacagaaaataagaacaaaaatacaacacgggcaacgtggatttgtttgcttgtttgcttacacatataagtagcatggctaaagatggttttgctggaatagagatatttgtataaagaaggtgagccagccagcctttcaacaatctgaaggaagagcatatccccggtccaggaccaggtaaatgccaatatcctgaagcaagggaaagattatagtattcagagaacacagaggagcctagcatgttgagcaggaaaacagggagggtagtgatgaagtctaagaggaaggagaaagggggggtcaactgggtcttaaaatccattgtaaagaacatggcttctactctgaatcagatgggggaagctgctgggacactttgagcaaaaaactgtcgggaagtggctcagattttagaaggatcactcaggtggctgcgttgagagaggactaaaaaggaggggatccagaagtggaaatccggaagcagggatgagaggcctgggtctgaaacccaggatccggaagtggggatccgaaagcaggaatgaggggccaggatcaggaaacaggaatccagaagccttaaggcagaagccaggaggcagaagtggggatgtgattaggaagctaatacaattcccagttaaagacagaactgagcggattaggggaaacacagggaaaggtgaatcaaggcagatctgaggatttgcggtggcttgcagaaaatgtttagagtggagaatgactgcaggcctcttttgccacaaactgctgcaagagcagcattgccgattactcaaatggaggctattgagagaaagagtgcttaagggaaaagtccttaatttccttggggatgctcgtatttccagaaagagagtaatcatttgtcgatcactgtgactgctatgcttttggcctttttttttttttttcccaaataggcttttttctaaggaatagatcaagtaccaagctacaggatactcccacgctataggactgcagttcagatacatgggtaataaaagaggcaaaagacacagaattaactttatttctacctttaaattttcctggtaagccatgaaggatcttatcggggtgatgcactcattctaaaactagatgatggtgatggttgcacaagtcagtaaatactaaaaatcactcaactgtacacttaaaataagtgatttttatggtatagaaattatatttcaataaagttctttaaaacatttttcccagtgaggctgttttcaacgtttggtgagaatgagaaaagtgtggaaggatgttgtcccaccttgttagtgattaaatctgctttaaagatatcatagagggaatgtctaccaccctttggctgatatgttaaactcccgtcattctaggactcatcttcactgaaaatataatggaatcttccatgaattctgtacagacatttttggtttgtaaaattgcaagaactaaagtttgggatgctcctcacaatgagacatatgcaatgtgaattttgggtatatttgtaacagtgacagaacaacattttaatgaaaactgcaatagttgcattttcattcaataaaagtccacttaaatttgggagatgcagcttccattctagattataagttgctccgatatactaggaagtgtcaggacagcttggccttcctactttcagttagcaccctcatgaccctggggctgtcacaggatttctgcccagatcctgaggatcttgtgatagtaaggctctgtaacaaatcatgagagcaaaaccaccttggtcacctccactaggcaggaggtgccactgcaactcttacaggaaattaattcagcatctgtctctagaggctgagaaccacttctgtctgaggtctgattttgcagtcttattcacagagcaccagcccaaatcctgcaggcaactgaacagatggtaatatattttgaccagaacatctctggatcgcatttgaaccatgaaactcaaggtgaagcattctgaggctttttattgataactacctcctaacccacaattaattatttatttcacttgcctctctaaattttcaaatcacttggagacagagtcttaagacaaggtttgatgtctttatttacaatttcactttaaagtttgcttagttcatgaatttgcctccctgaggagaaaaaaaaagtgttttgtttgtttgtttgtttgtttttaaaaaaaagaggcttttaaatgtaaggttacagtatttgttaatgtcccaataaataaatttacttaaaataaaataaatttaaattagcttctgtgtaagaagatgacttgttattagtaagagactaatgtaactaatctgtatttatgaaaccagatccttataattagtcaagcagatgtctaattaatttggaaggtacacagccatatggatgcaactagaaaaataaacttgaagatattattaatagctggtcaaattatgtccttcaaccgtcacagattaaccacaaatgtaacacactgttgatctgattacacagaggttttaaaatatcaaggcagtcagaactgaacaaaattatagcaatgattaaatgactcaggaggggtttaaattctagatgttatgaagcaaacgtaggagtcaaattcactttcaatttaacaatcatttcaagaaaggctattttgtctagaatagctaaaattcagtctttctctttgaaaatcaattgaatggtgtttgatacagaatatcttaaagcaaaaactcaacagatgttgataatgaaaacccccccgccacttcaaagtttaaaaaaactcccttatgttatcttctatgatatactgcaggtaaaattccaattttgtccttagccataaatgtacatggtaccttcaaacacatctggtcccattctctaaaacagcaaagccacctgttgactaactataaatatgaacatagagacagtgaatctgcattccatgtgtgcctggtagcaaggatagtattctgtgtctgggaagaaaaggaagactgacctttggaagaacggaagtgtttgctgggggcagtgaagcctcgagttccatgcacattcacagcagccactcgaaactggtaccatcggctgggtcttatgtcagtcagttgaactcgctcgtctgtggtctgaggggacatgtcacagagcacagggaacatgtcactttttattccgacatgttagttggatctgtttagaaaaatacactaacccatcagccaatgcaactcagtctgtcttccccctgataagaggggcttatcatgcccagttatgaagagagctgtcagggaacaaagaaccactgatatttcaccccaaagaattaaacatctcttgaagtcaaaaccttatgacaagagcttgggctatttttaaatctggtgactaattacagcatttgagatattcaatcaatagagaatatttatgtatagtaattgttacattacagcaagaagatgaaatcatcttcagattatagaaagaaaatgtctttttaactcacatgccaaatataactgtaaaataggtataacaacccacatgcaacccactagcaatttctggaagtaaagtataacccaagccactgtttaaaaatctcttgagtaagtcacataacatctatgaagaaccagtcctgatctaaaagggtgagatgtgttagcatatatttgctcaataaaatgcccaaaaggaaaaaaatagacactggggaagatcagaaggttttgctgtctctagtgctacaattttaagatatcaaataactttaacagtcttcatactatatacctgctttcaacaatgttctgtgttttgtttccattggtagatctgaaaacctttgccttgaattccaagaaataaccatctacagtctatgccctcatctacaccaggtgccgaactcaacttggatctgtggatgaaactaaggaaacaggattggatttgaacactcccaaacttcagattataataacctcagcttaaaataacttaatgtgaaaatgactgtcacgtttacatcaatatctaaaagaagctgaacatttctgagatcaaaggaagaatatgaactcttacatgtggctttctacctgatttggcagactttgagaaaacactttcaacttcatcatttagagtttcagctgcgaatttaaaaagcttaaagtcagcatggtatccacagcgtttagcagagaaggaagtactacatgtagcactaacagtaaaaaataataccagcaacaataataaaagagcttttcactttccaaaaatcttttggagataaaagagatggtcttattgctggttactttcataattctttaagtaatttggaaaaattacaaatgaatctgtaccacgatttatgaaagcatgccgtgtaaatcaaatggaatttcaggctgtattctgattagctttatgttttactgaagcaaattttttttatataaaatataggtatagaatagaattactaaatttatttgaccaggttttttttttttctaatttaatgttgtgtttttacatcaaacttcttatttattttggggtctttacattgttttattttagtgcttaacccctttgagatactgctatttagaagatattcttcttccaaacacctaaatattgacatttattttacatttactgaaaaaaaaaaaaataggaatctagtccttggaaaaaatgatctaatcaacataaggtgagattttttttcctatagacatagatgtggagaaggcattttagttgtctaaaggcatgaaacagtttcacattcagaatctgttactttttatatccatgtagggtttgtgtgtgtgtgtgggggggtggttagcagctggtactggatttaacagctcttaaaaagaaagaaaatattttgcttttctcatcaacaagacagaagaggaggaagcactctctgggagtgttgccatgcaggtggtatatcagtttttaagttgactaagacaaagaagaaagtacttagtgaagatttatgggctgctggctatgtcccactaagtaattttgtgatacaaatcttatgccatgctcctaaagtctgtgggtggaataaaggtgtaaatgcaggagaaacagaagagaaggcatttagattattaaatgtcaaattagtccttataatgttgcatttcccttcctctagttggctttgagtttagctgaggaaaatgtggttcttggagaaaatacatgtgaataatcaggttataaaattatctcccttccatgtgtatttgaacaaattaagccaatggtcgagtttccgagcacattcgtttgtatctatgaacctcatcctctctttagaagaccccatgatgttcatttcatatctgagtaatttatttctgtagtcaagctattttgaggcatagcaagttaattttttgtgcgtagctatgtagcagacactacctccaggatgaaaatcaaagtctatatgaggttcttacctgggccactgtctgccagtgagtggcgtcatcttcgctaggatggattccataattccatcttctttgtaccacatagatcacaggctcaatagaaatattgaatttcgaggaccacttaacctccagctgtccagactgcagttctgtaaatcgtaactcttttctgggcttcagggggacacctgaaacaggaccgtatcaattaaaacaatctgcgtgtgactcaaattgaagtaaaagttgaggaagaacaaatatggaagagatgaatctgatctgatgacaactgagatttcctttcataaaagtggcctctccatacagggtttcacatctgaagtcttctgacactcagttcagctatttgctcctttttcttttaacttgtcttttttttcttttttttaataagacagtctaaattggttcctgattctgtaacaagtggcttattccctagtaatctctagagcaatcatttcatgtgcattcttttcaataaatcatgttacaaggttgtttcatttgaggttaacatggaattcacactaggagatcattataaagagtttcaagtcattttcccattttttatcatgctctgtgtctattgatatatcctaaggtcattataacatggtttccagatttgatcttccttctttctcagggagtttttcatttaaggaaaacactgcaaagcaaaatctcttcatgtgaaatctcctaagagtgatttccaaagttcaagtcttttggattccgcaatcaattgctcaagcattcccctatatatagtcttaatggcttaacattggaaaataatgaatttataatgtttggttttggcatgagtgagtgtgctgcttcaaaagtttctcacaggtgtttcattttaaagtagttaatcattctgatttctttatcgccttctgtacatgcaagttgtctggcaactgatacattgaagaaccacagttcaaaatagcaggcatttcagaaagggaatttgtaaagaaatttgtaatactaatagaatatgcaaaactaactgaatgaaatagaatctatggctccatgatggtgaatgccatcaacaccaagaacaccaattaccattaatagcattttctgtacacaatggtcgtttgctgaaagcattgaaaactcatttcaaaagctagttaagaatgctctatttcttcttccattttgtaagtttaaacacagaagaaactggaaaatgtgcaaacaccaaatgcaaataaggtttgatgcatgttgacatggttgaatttcaactcctatttcattttgatcttaattcatggtaagtcttgtttacgaaaattttaaagtcatcaaatatttggatggatggaattgaataatttttttaaagcatatttatatatggtcaaaagtcattaatctaaaaaaagctattttctggagaaaatgtttaccatacctattgcagtctcctttattactgatgggtcatggctgagtagtgacctttagtttacaataaatttgtctcatctgatcctcactgtgagtttgtgaagtgggtaaagggttaattatctacatgttgaataggagataactgaatctaaggaatattaaattagttgcctgggactacaatctgatctcaggtttctctctgaattatctgctgctttctacatttcatattagaaaaggccacatagagagatagagaaaagagatggttttgatagatatgcaaatcccttggacattcttattctaagatcctcagctttcctggtggatctggaacttcaccaagtcagtctttgactcctgttctgccatgacatgcatttatttcaagcttgtattgtaaacttttcatctcagtgcataaccatagcaatgggggtacctagacttggatgattagcatactgctgctaagcaaatgtttttccagtctatctctaatccctggctaagctgcagaccatcttttccacctgcctgctgaatttctctgtcccagatatgccccttctcctgggatatctatctttatgacaactttattctttaggatgtctaagggatcttagaacctttttgatatgttcttgcagctaacaacatttagttgtcttactgcatagtacattttcaagaattatcaaatcattttgtctccatgatggccacctgactttactcccttccttgttcccaacctatttccctgcatctcaatctctttttctactgtccccttattggtactttggggttatttttctaacgtagaagcgaggttctctccttcagtttcccaaactctttaattgcatcccattctctatagaatgaagggaaacttcttggcatccccttcaaggcatccttcttcataattggctaccatttatttgtcaatctatctcctggtacatctttaattttttgtcacagatattatctttaaacccagctttcctacaaatacactgccaggtccttaataataccatggcctgtttatggtttttttgtttgtttgtttgtttgttttcattctgaaatgtcttgccttctgctttctaactgtaggcccttgaatatttccaggctcggaccaaatgccacccctctgtgacacttcccctaaacttctcaattggaaataaaggctttattcttttgccccccttcaatgttgagcctgtaactgtcaagacatgcatttaactgcctcttgctgcagcaaattcatttaatgatgcctgtctttccattaagccacagcccccagaggtcaaaaaccatgtctccttcattcccgcacctcacaatgtcccagaagagaacattctgcaatagcaaatgttcaatgaacagtcaatgtttgctgaactaatagccaaacccactttcttattcttcactcaagaatatgtctgtggaaataagagactagtgcaacatttatgcaaaccactgcaacaatggtaatccctactctgtttgaaagtcacctagggaagggtgaagatttatcataagtattctgtactgccatctttatcatatattgtttcaagcaactcagatctcttttccagcatggtcttattactcacatgtacattcactctgttttttaaaaagataaataccagaaaataaagcaatgccaaaatgtttacaagatagaacgtttttattacactgaccataggactttcccattaaaaagaaaaaaaagaccaattcctgatcggagagaaaacccaaagttaattgattttaatagaagcagctctgtatgttttgtgtcaagaaaaaagccaccaaaatttgttcagagtgatgaaaaaccaatctcaacaaggtgatcatttagtatcattcttgcattgaagggtggcctgcatatgccagacaaatagttctaccgaaggggataaggcgagggagagtagccgcagagaacatttcatgatttacttgattccttggtgcatagtaaaaaaaaatgatgaccaattcttcaaactcatagagcacattctccgagacttctgaatctacctttctctttggctttccaatgtataatcttctagagtaaatatagctacagtaaatagcctccgaagtgacctgaactcaccagaagccaatccaagcagcccagtgccctcgctgtaaggttttaatcttgaatagcattcaaggaccaacagccttaatcaaatgtaatgagcatcagggcgatgtcagttcaaatttcttcatttaaaaatctctttaattatgatgaagcatgaccctgcaatttgcatgttaagaaatggtccatctgctttccattaaagtcagttggctcctttgattggaagtaactccagcgctctactgtaattgtgtgcagatggggctcaacccccctcaagacctccagccctcactgccggggcgcacagtcctcactggctgaaccagcatcccaactgcataaccagatgtatagactggatctcttctcaatgtgttttttattatgtaaatgattagcatttttctctttaaaattacttttgaacaaattagtcatctgaaatctaaatgattctgttgaaaaatttacaaacgttatcgtatggcaaactgcaatatgtgacgtccagtttttttctttgaaatgcaagaaacattctgctgaaatcaaaggaacagaaacccaatgctttttaaaaatgttgaaaatatatggatagaaaaatcaattaggataagcaatctacagttgcatactcattgtgagattttattactattaatttttatcatgaatctaaatgatataaaaatgtagcaagatgtattgttctagtgatttaatcactacttgatatctctcataaaggtaattagaactctagaatttgtatttacatcacattaaggcattgggctactggatgcaaaatgttgaaaatttatttgtgagaagttgtataaatctatttccagaggtctgaagtttcactatttgatatattaattatttgtggaaatattaaattaactctatgatcgggtctttttgaaaagaaacagactgaagtacaattaattcttggtttatccatggcaaaaggaaactataggtcacaaattagtctgaatctttacgtttgtaaaattttttaacttttctttctccctgcccaaaccatttttgctacagttggaagccaagagaggcagtgggatttggcaacaaaatagtaaaatatatcaccctctggaggaaagattgtctcaccaagccataaaatagacttagagaggaaatagaaatagaaaggaaaaaggaagtgagtgcccccaaatgcactcatttgtattctacctgtagactttctacaactatatgaagttttgcatttcatagaactagtaccagcaggcatctccaatcatgttaatatttccaagccttcattttgatgctaataattttatttaaaaagtaaaagaaaggatctctgctgtttgttttaaactatagtctatgaaggttaacttacttccaggcatcagttaagtgcagttcttacagcatagcccaaaatcatattttcaagacacccatcgcttttaaaaactcaagtgaccagtataaaaagctcttgaagctataaaaccagtactttctatcttcccttccacaaacacagcagaccaaacagaaagtatgtatgagtttttataatttaaaaatatttttaaaaattaattcattaagtaataaaatgaaatatatacagaggttggtaaatgtccatttatttaaaggttagaaaaacaatttgcccacttaaagagtattgtgagcatgacaatctcagtaataaactactggaccatgtggggggttagtgtcacatggatccttgcaccccaatgcccattatagatgacagcaaatagtaggcactccgtaaatgtgtattcaactgaaatgtgtcaatacttctccatccaagtgacagcagccccttgtaaaggtaaaccggggaaatgttaagaaaatgttatttcggatttccaaacagcactatgcaacactttaatacataaaaaatgaatgaatgaggaacttcaggttttcaatatttatcccatagaatgtggttctccatatagcacactctgtatctagttttatacgcttcaactctacaatgtaaaacaatcccatgttattcattagcctaaaatgattcataaagtagtgattttgttggattaaaaatattctatattgacaaatcttttagttggcctattagatagacaggtggataacagatttagatacattttgggacagggtctcactctgttgcccagactggagtgcagtggcatgatcatggctcattgtaacctcgaattcctgtgctcaaatgatcctcccacctcagcctcccaagtagctatgactacaggcacatgccaccatgcctagctaattttattatgtttgtagagatagggatatcttgccatcttgcccaggctactcttgaactcctgcctcagcctcccaaagtgctgggattaaaggggtgagccactgtgtcagaccttagttagcctattatatcataacacaaccatgcccagtgagtgtttccattagagatccatacattcaaaataaaaatgacaggagagctagcccagatgggagcagatgttagatctatttctgctacctactaccaaatcacttaggcatagcctgcaacctctgtttcagcagctgtgaacagagagcaggactagataatctcaacccaccatgactcccactcttattaaagaaaaaaactacacagacctagcagagacagagagagggaggcaatcttatttcacattagtttggggcaataagaaggcatcttggaggtaggaaagacagtgatcacgagtatcctaagattgcaggttggtttgtgcgctgactgggcacatggttttctccttgcaaagccaagggatgggttagaacggacactttccctggggcttgtgtacatcagtccccctctcctcttttgagagtgaagaagcagctggactccaggttgggaatgccaaaagggacttcaaatgcctcattagctaagatgatgaaggagttgctgtaggctctatttgccctccttttacacacactaacatattaagaggcactgtcaaagctcccaggacatgaaaaccagccttcctggagggactactgaagaaagcaagaaaaaaaatctacatatatatatatgtgtatatatatatatatatatatatatatatatatatatatacacatatatatacacatatatatatctacatatatatgtgtatatatatatacatatatatatatatattttttttttgcaaaataacaatctattaacttgactgtcttcattacacaaaagtcactgtcaggttaacagagtctgtttattctatttgtagttgattcccattgattctctctctctccacaaaaatctaagttaagagctaatttgtagtagaagagtgacttcagtactttaacaaaagttcacctggtttcgttaaacgtagttttacattgaaagtgtctttgtatacttaatcatttattctggcccgttctacaatattccccttattctcaagtgaaacaggcatatttgaaattcatattaactcttcagtccttttataaaagtgcatattttaatttatattatctctttaaaacactataggttttacaaaagggtttaaaaagacgattcccaaagcatcctatttttatggtgaatgctactcatacatagcatattatctttaatgacagataagatttcataataacagatgctttaaaagttagatggttttaaatttcgcaaaagtgacttgctgtaatttaaaataagaggcatgaccacaataaaactttaaaactattaaagaaacatcacttggtaagaagagaaaagcattgattattttgaatgtaagacataggacttatggtgtgtttccaacgataaagaaaaaaaaaccggttgaattacatagatttcagaggaaagtattcccaagtgggagctaaaggaagatgggacagatacttaacttctgggagatgtgaattgttgtaagtgttagagtaacatggacttccaaaaataggcagccagcacataaatcaaaactggcattgatggtgaatacttctttatacacattttttttaagtaccagtatttagaaataatatggatttggcatgtgtatgtgaaagacatagagagagaaagacatctgttactctctctgtactttaatgaatactgcctactgactgactctatattaggggtccccagctcccgggccactgactggtagcagtctgtggcctgttaggaactgggtcacacagcaggaggtaagtggtgggtgagtggacaaagcttcaactgtatttacagccactcctcatcactcacattaccacctgaacctcctgtcagatcatcagcagctttagattctcataggagcatgaaccctattgtgaattacacgtgagggatctaggttgcatgctctttatgagaatccaatgcctgatgatctgtcactgtctcccatcacccccagatgggaccatccagttgcaggaaaacaagcccagggttcctaccgattctacgtgacggtgagttgtataattatttcattacatattacaatgttataataatagaaataaagtgcacaataaatgtaatgtgcttgaatcatcccaaaaccatcccctgccccctcccccaacatggaaaaattatcttccatgaaaccagtccctgttgccaaaaaggttggggactgctgctctatataactcttcaatgagacccccaaaattaacaaaatgttatatgtcacggtgtattttgatggtatcccaaactatacctaatacaatggattcatcttggctttaaaagagcttagtcccatttacagaaaatgatcagcagcactcgatattaaggagctaagtgctctagaaacggcttttgaatataaactattgcatttgctaaaccgtttgataaactgaacctccatgttttgaggaagggaaatcctttgtctagaatctcaaggtactaatgaaaatatttaagatctgtacaacgacactaatgttcttgggtcatatcggcagaaaaagcacaataccagtatatttgttatgcatttttcaagtgtgcttcatctcccagcctattttctaaggatttaaatcgatttattccagtgtacctagtagagcttacttgaatcagtctgactgaagaaaaagacaaaaatgttcctgaattgttgctgtccatcacatatgtcaaattaaaaagaattaatatgaatgacttgctctgccccatgtcgagttaatatggctaatctttatgggtctgtgattatgttaagatgtctgtatgtggtataaaataaattttctaaagattttatgttttttagacttttcacacctatgatggacacccttccctaggcacacacagatatatgtgacactgcatgtgtcttcacacccccagtgctgccccttacctttgtacagagtcttgggtacttgacaggtgtgtccacacccattcgaacaacatttcttcaccccagagcactcattgtcaacttcgcagctttcaacacaggcggccgcaaatccactggctttctcaggagccggacagtccccctgcttcaccaacaggatgtatttgaggaactcacagctggtcaagcattcgtagctcttcttggggaagagaggctaagtcaaagaagaattttaaaaaatattccattaaagacacatgaagtctgatttccaagacatctgaaaggaagttcaacatttttccccaccaaacctttgtttgaatatttgacaaaatgcatgtatttgttttcttttctcctatccaagtgacattttgtgctgatttctcaaaggaacataatccataagtgatgattttatattgcatgcaacagacaaacaccatgtatatgcgcccacgttcacagatcatatattctatcttggtcaaagatgttttccaaaaaaactgattatagtcacaaaacctgttcagtacaatttgagggccctttttggattatatacattacacttataacacatcactctctttaattttttctttctccctttttttttttttttttttttttttttttacagttaaggtctcactttgtcaccccaggctggagtgcagtggtgcaatcacagttcactgaagccttgaactcccaacctcaggcaatcctcctgcctcagcctcccaagtaactagaactacagacacacaccaccatccctggctaatttttattttttgtagaaatgaggtcttgctatgttgtccagggtggtattaagtcctggcctccagcaaatctcccactctaagcctcccaaagcactgggattgcaggcatgagccattgcacctggctattttctcatatatcataaatactcatcaaaatagcaggagctctataaaactttacaattctcacaatggtaacatatttattggtattgtatagcacagttgtctaagcgttctaattgaacatatttcaataatttccagcctttattattaatatggaattgtcaatgagttctgcagtagaagaatgtgaatcttctttaaaaatcagcccacacctatgttatctgtgacacagttggggtctgaacagcatcttgctgaggacattttggttgagcccagaatcaatcaaccattagtgagaataggaagccctggacttattagaggaatgcattattgaaaaagcctgagtaatgtgaaagagccatttatcaaatgcctatttttccttaggaaaaaatggttcaggacagcactcggtcatccctaagacaggagctgcaattggaagataatggctcttttctgccactgaacagaggagttgctgagatttctaaaagctgtcccatccagggaaagaaagggaaggatgctctctgtgctcttgctctcctttttcctatggaagagaatggccaagacagccccaccagccccagccctccacccagccctatccctaaccctctttttgctttatagaagatggctgaaaagatgatcaccataaccctaacttttataccaagcctccttttatccttatgggagatggtttccatgataactactattccattaaagacacatgaagtctgcttgaatgtttaacaaaatagatgtatttgttttcttttctcctatcaaagtgacattttcttttatcaaaatgcattttcacctggaatgcctgtgcatagccaggttaaatttcactgtctcttttacctgggggtggctacgttgttgtgaatggaacgtaatcagcaaagttctgtgccactgtggaccgaggcttgcagatggtgggggatggtgcccccgtgttcttctttattagctggatatgggtggcaccacagctgtagggaatgagggaatggtggggccacaggaggagagacgccagaatgctgtctgcccatatggagaaggacagcaccctgccgggaacagctgccttgaactgcttcatgggtataaagcaagtacacacgtgtttgaactcttgtacatgtcaagctccgtttgctacaaccattcagggtacctgaaccaatgcaaaggccatccagtgaagggctgccatggttcctcaacgttggaagtggaagatgaacaaggaggacactttctgtttatttgatgtcacaacagggttaggaatataagaaataaatgtggtagctttggtgaacagaagtctagggggagaataggaacatcaagcagctcagtgccagcatgctgcttgatgctccacagtgatccctaaccagggctcattactggtaacatctggaaacacctgggttacacctggacgatacctgggaacactcgcctgtgtgctgcctgctgctcctccctgatgactaaatatggctctgcaccatcgtgacacctgggtaacaccgggtcatccctaccattgcctggtaatgcctgggcaacacctggtaagaccagctcatgtgttgctgttgcttctcaatagtgattgaatatggctccctaccacgaggtaacacctgccaaacctgccagcatgctgctggctactcctcactgttaaacaaccatgaccctttagtcagataggtgtctggtagcacctagataccctggagataggaggttatctaggcaggagactgaatggtttgggctattaaccagagagtatttcaccaatagtggaggtatgttataaaacaaacaaacaaacaaacaaaaccaccattatcaaagtctctagtgggaggtggaaggttggtgggaggaatgtctctcttttccggcagttagttcattaattttagcctatgattctcagattgatgatgactggaaattccactgaagactcaaaacataacttcagcaaggaatatcttagtaatcctagaataaactacaatttcaacgtaaatgattctccactgtctcacctgcttcttttccccaaacaatgttcaattaaaatatgcgtaagagttgacggcaaatgttatattatgtgcattttaccacaattttaaaaaaacactgtgaaagagacagaaaatttttataccatgagaatgtgtgcagcaccaaattgttattgtttcatagtgacaataatctttctgatattgtaaatttagtggatgacaaagcattagtacttcattacaagttaaatacaattaaatgcctgttcttttcttaattaacaaaaggaaaacagtggaaacactagctagaaaaactataatttcaaggtttgaattagaattgtagatgtcatataaaattgtttgttagtaattaatcatacataaaacgtgaaaataacatgagttgactgaactaaaattatttctcaatttaagaactttaaggtaaaacttagaagggccatggtgtcaatattgaattatgacaaatttacagctaatttaattaaaaagaaactttataagtatttaaagcattattaactctcaaggcttttatctcttactctatttcacagtccatttttctgttagctgttagatgtgttttacttcattgagttttgaagctctaagtttagtttcaaacctaagttaataatcaaagaagtatgctaacagatctgtaacaattatgtagtatttgccaactttcttctttcaacaattcatatacattacacacactgaaagaaaatacttagttaccaaaatcattggccagtgcctcatgggctgagatttccaagtagaaatacttgtattaggccgggcgtggtggctcacgcctgtaatcccagcactttgggaggccgaggcaggtggatcacgaggtcaggagatcgagaccatcctggctaacacagtgaaaccctgtctctacttaaaaaaatacaaaaaattagccgggcatggtggcaggtgcctgtagtcccagctacttgggaggctgaggcaggagaatggcatgaacctgggaggcggagcttgcagtgagccgagatcgcaccactgcactccagcctgggcaaccaaagcgagactttgtctcaaaaaaaaaaaaaaaaaaaaagaaatacttgtattaaatctggcaagtgtttcctgcttggtaacttggaaatcacagtgacttagtttgcatcatgatataatgaaatcaactcagttcatactcttcatctatgaaaacagagtatgagtcaagaatcagataaagtttggatcctgtattcgtatattattctaattatctatatgccaactgccacacatttgaactgtgagggacaggaaaacagaggctatgtctccttatcttcattatttactgaactattggggcagacataaaaacaaataaacaaagacagtaacctagaacagttatgaagcatgtgttcccaatgactataaaaggggaatgatcataattagcccaacaatttagatctttcagttgatatgagagttattctgtatggatattcaatgttttcctttttggtaaggacatagaaacacatatgttcatctttgcacccatggtttctagactggtttataatcttgaaataatacaggtaacattatgaatattacatgaggtaacacacacaaagaattaagcactattgtgcatagttggcccacaatacatactcaataagaattaagtaatttgtgtctttttttcttttatcactgctacaagtttactctttaacatttcaaaattcttctggtgtgctcatgaaaattttgtaagatccaaagacagaaggaagtctgtattcttctacagtgtgtccagccactagattccaacccactacttccagattaagcactgaaatctgcatctcaggaattgtaccctgtacttaaatgaagttcatcttagagcagtgtggatttggtgcaacagtcttacagaggagctttatttaactgttctattaaaggcagatttatcaaagggaggttttgatgctgtctattaattttctttcataattctcttggattgggttgaaaaaatattatttgtttgaatataaattagagaacatatggtatgtgtacataaggtctctctccaggtcattaataatagtttaatgagaatttattgattgaatggaataaggagaaaaatgtgtacaggtcagagaaaatgctgtgtgaatattaatactctagatataaacaaaatgtgcaaattggtctccagtaggaaatcctgtgaacaaaggtaatttgagtgtcacaaaagtataataatttctgaccattaagcatgtaaaatttcatgtgataatacaaattactcagagatttgttaaaaggaatgagaaaataatagaaaaagacttattcaaatcagtatgcatgtaatacccatcaattttatggtcaataaacacgtgtgacaacatagattctatgttctatttcctgtttctaaaattatatgcaggtaatgaaggcaaattgttaactgtaaatttagtttttataactacaattcatttttataaaactattcatatgattaatttcacgaatcacacaaatgtcactctcaaattattattattattattattattattttgagagagtctcactctgtcgccaggctagagtacacttgcatgatctcggctcactgcaacctccaactccctggctcaagcgattcccctgcctcggcctcccaagtagctgggattacaggcatgcgccaccatgtccagctaatttttgtatttttagtagagatggggtttcatcatgttggccaggatggtcttgatctcctgacctcaagtgatctgcctgccttggcctcccaaagtgctgggattacaggcgtgagccaccgcacccagccaaatgtcattcttttgccaggtcattggctccaatttaaaatttgaaaagaatatggtcactatgcccattaattttgtttattttgcccttactgtccccaaaactaagaaagaattagtctgcaaagattatgtattttttctagattagtgattaatagtatctaatggatgtcattatgcctccaaagaagagataaagcaaagtgttaaagaaaaatatctttgaggtgcattggattaagtaaaaaatccttcatatgttaacgaatagatatatgtcatactatatattaatatgcagtattaatgaattctcatatatcccttctacatgtcatctcctaagagctaaaaactaaaatgtggtttttagtgacttacctgggtaatatgctaagctccactaagaagaaaatgaataaaacattaatttatccacctgtggcaagtagctaaaaataaaattaaatactaacaaaagtaggcaacatttcttgaatgctttcagaaagagagacagtactatctttgtttagtttggtataaaatgcaaggtattgtacagtaaaataatctgttcagcaatcatggaatgataaagacatccaattcagtaaattatcttaatgtgtttaaaatcacataaatacaaggcttcagctatgaggagaacattgcatttggctatttggttcaattcaacagacttgtaccatacgtcaattctctaggattataattgcctttgcaaagagtcagggaatggggggcttcgcttcctgctcctagccaacaactgggattgctgaatacaatgaaacctcaaatatacaatttcctaaagtgagtgctccatcattatcaccactgtcataaccaccaccatcaccatcattaccatcatcattagcagtggcagttggtcaccaagagatgctgatgtctatcacatccctcactctaccccagctgctttactttctcatttcacctattcttccccagtccccacaactgttattatttccattttaaaaatggggaaacaacagctcagggagatcataacatagcccaaatcacaaaacacgtaagagtctgggcaacgatgagagctagtgttttctgagggccccaccatatctcacggtaaaataagaggactgggctcacccagtggctctcagcttgcttccctattagaatttcccagggagcttctaaaactgatgtcttgggtgaacttctgacccgtttcttcagcattccaggcatggaccctggaaactgcactttggaaagaaccgcagatggtcccaatgtctggccaagactagaaatctgctggatgaatagctctctaatttgtgttcagttattagacttcctgattctacatgtttagaaataacctgaatattcaaaaatgcaatcttacacttcctgggaagagatagtggggtgatttcaaatttctttctttttttattccttttctttagcaaacaaatttttaatcttaattctatgctgagtagttgaatagctccatctacccagatacagaaaagctaaatgcatttataaacagaaaatctaagtgtacataaactcctagagaccactgagggtaactaaattaaagtactccaaactataatccaggggttactgaaaatctgattctgatacatccgtctctgtatgtacaaaagatatatttcaggatgctcaaaattaaagcactgacattctaaacaccaagcaatcactgaattaaagtatgttggtaattctttgaacacagtgtctctgaagtcagtgacatcaaaaaaatagcacatgctcttccttttgtattttcactatattaaaaagcaacagtacaaatgctgtggtgttaaaaaggatccttattttttaacaaaggaacttttataaacaattctgtaatgaaaggaaaatagtatgttaatacataaaagtttttgttaaacaagattttacaatttttaaatcagaaaatgttaagattaaatgttaagattaaacaaaaaagcaacctacacaatttccattaaatgtgtctttgtacacatgtcctgggcactttgaaaatgttaaaatcattaaagtttgacttctgccgctgctgcccccatctcagcattgccccctccctaacctggccaaagggtctgattccaaatttctgaaaacttcactcccaaaaaacacagcgagatgaacagaacatgaattcaatacaagagcatgaagacaaggtagtgagacaatgaaatgagatgaaaagggttagaaaagagttaaacaaaaatataaaatgtgaaataagacaaaaacataaagttaagaaataaactagaaatatcaagatcatctgaggtcaggagtttgagaccagcctggccaacatggagaaaccccgtctctcctaaaaatacaaaaattagccgggtgtggtggcagctactcgggaggctcagatgggagaatcccttgaacctgggaggcggaggttgcagtgagccgagattgaaccactgcactctagactgggcgacagaaggagactccatctcaaaaaaaaaaaaaaaaaaggaaaagaaagaaaagaaaagaaagaaagatagatcaaggaattaatagaaaaaaattataaatcaaagggcaggttatgttccaagaataactgaaaagagcaagcaacactggaatatagcttctgcttctgaacaccaaagggaaaactttaatttttcaggcattcaggtaaaaaaggcaagctgattatgaggaagaaaatataattgctaccaaatgtctctctactaaatttagtatgtgaagctaacaaagcaatgtctatataattctaaggaaaataaactctgtgagtgtatgtgccttgtgggggggttgtgttgggggcagggggcatgatgtgccatgcaatggcaaaacctagccatcctatcataaacagaaaacaagaacaaatgggctagtacaatattcggtacccagataaaataaagtaatacttatagaagaaaaaaaagttgtccaatccaagtgtactttagatataactgtaggtaaaatttatcatgcataaacttaaagaaaacaccatccatagacccctgtttaaaaacaaagatatgaattaaatttacaaaattaagcatacagtggaaaaaagaatcagtaaaattaatcatttttctatgtacctaagtatgaaactaaaattaaataaaataagaatgataggagggagaatttgctgtgataaaactaagaattttcaaataataatatgttagaaaaactggtaggtgggaggagtggtggagaaaacctatgagtgtgacttatcttgaacttaatattagaacatcagtaaataataaaacaaatatggaattgaaagagtaacaattccaaccacataatatcttttataatcttttctttataatattttggggtgtctttgtcttctcttgccttcaagtaatattaaactttaagcatttatttgaaactagtgtgcacagagcttccaggtgctggcctcttggccagccatttaagtaggcattgggagagcagtcttggccttgctgtgttaacacgtttctgcacagtaaaccatggctgtttctacatggtaaatctggaatgatggtttggttttacttttctgtgcggtttattaatttttaatgggcatgtatagtttctattaaaaataaatagtatacttggctgggtgtggtggctcacgcctgtaatcccagcactttgggaggccaaggcagacagatcacttgaggtcatgagtttgagaccagcctggccaacatggcaaagcctcacctctactaaaaatccaaaaaatcagccaggtgtggtggcacacaactgtaatcccagctacttggacaactgaggcaggagaatcttcaaactaggagacggaggttgcagtgagccaagattgcacaattgcactccggcctgggcaacagagtgagtgagattccaactcaaaaaagaaaatagggtgtacttttaaaaaatgaggcaaaactgccaagtgtgtctttcaaagaagacatctaaacactaggcatgaaataagaaaaataactctccgttcaaatgttactaatttatgcttggaagtattattataatttgcttggaagcccaattataaatactaatttcttagatgtgattgcaattaattggattcccaggcaaattatagacattggccatggaaaatataaaattaggagaaaagcagaaacacgcatattagagaagtcacttttctacaagtacataccctcttctttcaattacagtaatctttacttatgtttatcttggcttccttcttcctggcctggctcttctatttattttgaaaacaaatgtgtcaccttgtatgagtcagcaacacctcagaatcttgctgcaatatttctggaagatcatgaggcacataaatagctcgagaagttcacaaatccctagagaattagggatagttcaggtaccacatttaaactatgatttatttccctctcctacttctgcatttgttagtagtgaataccaagaatgccaatgcaatgttcagcccactaaaccatttatatactgatttatagaccaaaccggcattctaggtactaggaatttaatggtgaacaggtgaaattgtgaaaatgatgacccactatgcttagtttacatgtttactaacaaacaggtaaaaatcattaaacagtttagtttgcattataataaaggtagacacaggaagttacagatataaggacgagatcaacaaataattagacaaggacaaaactttaaagaccagtcatcaatactgatgatttaggcaagtaaaagtgatgtggaaaacagaagaaaaagagagagggaacagaaacaaatacagcctgtccccttcagagcttgacaaatacacaagcaagataactgctgtacaatttggggggcaaaattaatttggcaagtgtcactttcttcaaaatattaaaggaagataaaatattaccctaagccttaaataaagcttccaaaacacttagcatggatcctagcacataataaaggtgcaatcagtgctagccacctttattagcatcagaattctttaacgcagttctagaaattttacaagaaacaataggaatccatatacattaattatagatggcctaaaatcctcatgtaaataatttcttttaaagaggaacaaattagaaagttgtcaaatacagttgtttactctttgatttatattgttcagtttctttgctcatctcattttgcaaacactgtcaaattctacaaactcatcacatccatccaagatacaagaaaaaaaaatctcatattttacctcttagagatcttccttgaaatttcttatttctttgtttatacactactatattataccacttctggactggttagatcatcacaaaatgaaatagaaactaactgatatgattaggctttgtgtccccaaccaaatctcatcttgaattgtagtccccataatctccatgtgtcaaagaagagaccaggtgggagtaattgaatcatgggggcagtttcccccatgctgttcttgtgatagtgagtgagttctcacgagatctgatggttttataagggactcttcccccttcactaggcacttctccttcctgctgccttgtgaagatgccttgcttccccttcaccttctaccatgattgtaagtttcctgaggtctctccagccatgctgaaaagtgagtcaattaaacctctttcctttataaattacccagtctctggcagttctttatagcagtatgaaaacagaccaatacactaatgtacatagaacatagtttcctcgttatgaacaagtaagagaaagtacaaattccataagttaagggactggttcccaggggacattaggtaatatctggagatatttttgttcctcacaactggaaggtgctattggcatctagtgggtatgatctgagagaccaaaatggatgcccctttatcaactaaggggtatgctaaggttcttggttggcatggcacatttctaaattcctatagctaaacttgttaacaataggagctatcaactctgatttacaacccagacctctacaactctgattggacagaagactggccttataaagattattttctgataagcaactgcagaccacaagccagtttcagctagattatagaggctgtgcacaaattctgtgtcctgtagttcacttttcgatgtaaagagccaaattccacctcatcttaatgctaaaaccctgccccaaagtgaacattgaatgttatgttattacgagggtattttaagaaagttaaccaaagatttagcagaaaaatgtctgagaaagcttcatcagagagcctttctccaccataacaatggccctgctcattcctctcatcaaataacagtaattttgccagagtttcaatgggaaatcattaggcatccaccttacagtcctgatttgtctcctgacttgttcttgtttcctgttcttataagaatctttaggtcgggcatggtggctcatgcctgtaatcccagcactttgggaggccaaggcaggcggatcacgaggtcaggagatcgagaccatcctggctaacacggtgaaaccccatctctactaaaaatacaaaaaattagctgggcgtggtggtgggcgcctgtagtcccagctactcgggaggctgagacaggagaatggtgtgaacccgggaggcggagcttgcagtgagcccagattgtaccactgcactccagcctgggcgacagagcaagactccatctcaaaaaaaaaaaaaaaaaaaaaaaaaaaaacaacaacctttaaagagcacccatttttcttcagtgaataatatttttcaaaacctacattgacatggttaaattcccaggaccctcaattctttagggatggactaagtggctgataacatcacttataaaagtgtcttaagcttgatggagcttatgttgggaaacaaagcttatatgttttatttttggcttttgattccatttttccatgaactttctgaagtcctcttgtgtatgtaaccacgttattcagacattggacaataggtagcacaagacaagaaaacctataaggacacaaatgagatgagctacaattttgccaaaaaaatgatttgacgtagtttcaaatccacagtgcaaggaaggctaatcccaagatagctctgcaatttttccaagttgtggataaagagattaaagcttgaggctgagatggccagatcttgtgggcagactgtaaagcaggatgaaactgcatgaagagagaaacctacagggattcagagggaccctttgatttctggctgaatactgacttgaatgtgcatggcttcaaactgcataagtctggggaaagaataatcagacagcaataaaggaaaccattctagcaaaaactcacatttcaaccagtcagagtgcagagaatgcacaattcatgaagcattggctagagtcctcagaaggatatcacctagtaatgggataaattgggcctagtctaaaggctactactctgaacccgcccccaagaaagcttaaaagaaacttttaaaaataagaaaatgaatctcaaaaggaacttaactacatgccagaacaaagtctaacactttctggaaagatacagcaaaattcaaaacacaaaaatttgacatccaatcaaaaataatccagtgtgcaaagaagcaggaaattgcggcacataaaatgggaaaaaagggatctacagaagcaggaccagaaattatagaaatgatagcattaacagcaaaggacatttaagaactaatataaatatgctccatatgcccaggaatgtagaggaaaacatggacatagggaggacaggaatgaaagctacagaacagagctgcatagaaattccagaagtaaaaaggaagaaatgaaaaatatgtcaaataggatttttaaaatgttagacaccatagaagataagattacttaaaaggaaagcaaagacacaatgatttaaaataaataaataaataaataaactattaaaatgaagcagagggtgggaaatgaccaaaaggaaaaaaaaaagatcatagactcattgacccatgagacaaaataagctggtctaatgtgtgtaattagagtctcagaacaagagaagagagaagatgggagaaatcaataaataatattgaacaataaattaaaaatttgattaaaattgtatgtccaaagttagaggaatctcaattacccctaagcagaagaaacaaagataattaactcaaagtatacttaaccgtattgcttcatatgccagatactgaaggaaaatcttcaaagcagatagaaaaattaaaagatactttatatatagtaaaacaaggataagaatctcaaaggtttttcagaaaatatgcatgtcggaagaaaataaagcaatatctttaaaatgctatttaaaaaaaaaatcaacttagaattttatacccatgaaatatctttgaaaagtgaagatgccttaaagactaccacaggtatacaaaaggtgaactcatagccagcaacctagcattataagaaatgttaaaagcaaaaggaaaatgataacagatgaaccttggggtctacacaaagaatgaagaattctagaaataataaatacatgattatatttaaaagatgatttttcttatttttatatctctggaagaagataagtttaaagcaaaaaccataaaaatgtgatgtggagcttgcaacaaatgtagaagtatgatttaggacactaagaatacaaatgaagggagtaaacaatgaaagtatattgttatgacattttcatattatacatgaagtcattcaagatgaaacatactgtgttccaaaaagcaattctcaaaaaatttaaaaggatagaaatcctaagttttgtcttaactagaaatcagtaggaagatatatgtaaaattctcaaaaatttacaaaataaaccatacactcatatgaaattcaaaaatggaatcacagaagtaatcagaaaatacctgtgtaaaaataaaaacatgctataacacaaaatgtgggttttagctaaaatagtgcatagggcaaaatttatagcataaagctcttatatatgaaaggaaaataaggtctcaaattaattatctaagctcctacaataagaaattatataaagagagtcaaactaatcaaaattaagcaaaagtaaggaaataataaaggacagaaatcaatagcataggaaatgacaaaaaaataaagaaaaacaataaaacaagaagtttttttttttttttttaaagaagcactaaaattgacaaaattctattgggatgaatcaagaaaaagtagagaatacataacttaccaatgtcagtattgcaaaaagggttcatcactacaaacctaacagacatcaaaatgctaacgataaaggtgaattaggcgataatatgacctatgctatttttatcaatgtgataacttggatgaaatagttcacttcctacaaagacataggttataaatgctactaaagaagaaatagacaacgtgaatagtcttatgtctactaaaaaatggaaataacatataaaagtctcaataagtaaataaataaactttaagctcatacaggagcttctacttcttagagaagataaatatcagaattctttctaaattcctccatgaaagctctaccaactcacataaaaggagactctcttcattcattgattcatttaacctgagtacatcattctgctagttacatgagatgagaaggctaaactttattcctgctatcatgtttacaatgcattggggaataaagataaatcaacgattataattctgtatcttgaataataaaatagtgttttttgtttttatttataaagaaccattttcatctgctgattttttctttttcttgttccttctttttttttttgaaacagggtctcattctgtcacccaggctggagtgcagtggcacgaacatggctcgctacagcctcaacctcctgggctcaagaaatcctcctgcctcagcttcctgtctagctgggaccacaggtgaccacaagcatgtgacaccatgtttggctgattttttttattttttatttttcgaggagatggggtctgactttgttgtccaggctggtcttaaactcctgggctcaagtgatcctcccgtcttggcctcccaaaatgctggtattacaggtgtgagccactgagcctagcctcatctgctggttttcaatcattttaagcaattgcacattttctccccatagactatcactgcacaaatcacagaaggtttcacagaattggtagaaaacttcaagtgagtgcttttttgttgtttgttttttaaaacagggtctcactctgtcaccctggctagagtgcagtggcacaaacatggctcactgcagtctcgacctcctgggctcaagcaatcctcctgccccagcctcctgtgtagctgggaccacaggcatgtgccaccacaggcataaacatggctatccctaaaacagggagccccagtatccaagaagtacaaccacacacttgctactcaaaggctaggccttggttcagtagcattagcatcacttgggagcttgctggaaatgcagactctcctggccacaccatatacctactgaataccatatgcctactgaacaccatatacctacttaatcagaatctgcattaaagcagattcctagatgattcatgtgcgtgaccaagtctgagaaggccagttctggatcatgctggacactggagttggcatcttcagatgcatgagtttctccctctccatatttacatttccttcacccctagttccttactccagagatcaagttatccaatttgtgctccatgtatctctgacctcacactcctgacagcattcatttcccctgacatataaatgtattccagtctttccaaggtaaaacacaaaaatcactttctcaactgtgaattccccctaaacacagcctcttctctctcctctatgctctagagacagtgttagggaaagactttaaacttatagaaaaagttgcatgtatttggtctgaatttcctccttacattttattctataacgcagagttgtatctgttacctactattgatccacagaaagtctcccacacagatttccagtgacttcctaactacaaaactcagtgagcccttttagttcgcatctcactgacctccaatagaattaaaaagtgttgaccttgtctccttgtcttcctcttttataataaaagtagctaatatatatgtaatgtgtgttatcttcagatactgattaagtgctttatatgcattcaaaaaaaatttttttacttaaatttagtgcttttgcaattttcatgatactcccctaactccttatgtgcctatttgcctagcccttcttttcaggcttaggtctttaaatcattctgaataatctccagtcttggtcccataaattttcaaaactcatcaattctcctacaactgagtctagaataatttgatactcccccgagtaatataagaaaaatataaaaaaatttttatattttataaaaaatataaaaattgagtctcagtgcttaaaaaggaaaaaaagtttatgttccagatctataaaatttgatacaatgcagactgtacccatcatatggtggttggcaaagaatatctcataataattataaaaattcataagcattcttcaaaacatttccactttactactactacgtcccctaagtcgaaaagaagacttagatgaattctgcatctcttcattggtgcccaagtaacaccatctagaaatacaagtaacacttttatgtgttacaaaaatgtaaaataccaatgttaatcatttttaaaaataaaagcctattatttatcatactaaaaactttttgaaaattgtctatgtggctgagtgcggtggctcacgcctgtaattccaacactttgggaggctgaggcgggtggatcacgaggtcaggagttcaagaccagcctggccaagatggtgaaaccctgtctctactaaaaatacaaaaattagccaggtgtggtggcaggtgcctgtaatcccagctactcaggaggctgaggcaggagaatcgcttgaacctggggggcggaggttgcactgagccgagatcgtgccattgcactccagcctgggcgacagagcaagaccctgtctcaaaaaaaaaaaaaaaaagaaaagaaaagaaaagaaaattgtctatgtgtcagtcactccagcctccatccctttgtctggtccttactctcagctggtcaccctgattcctgttgcactgagaaaagtaaagcattcaaaagagaagttccatagacgccattttcacacccaccaatgcagctgcatctggtgcattaaaatctcatgcatccatggattctcatgtatccatgaattctcatgcatctcctgtcccaggacgtagaagcttgctcccatttcaaacctgcctccatacacacacaatggtagacattgccatttaaggtcatgtgcttcagcaattcccccctttctcctctaacatcaaataacccctctcttctgaataattttcatctgcttgtaaaatataattatttctctactctaaaaacaattaaatgtttgattaccttgttcacacctcttcccacaatctcatttgcgcccctgatcactttttttttttacagtaatgctcactgaaatgtttctatactccctctctgtttcctccaaccatttatctgaaattcatgccaattaggcattttcttctgccacccaataacactgctcttgtcaaagtccacagtgagctccctgtcgcagaatccgattaataaatttgaagtctccatgctcttgcagcacttgacgcaactgattacctcttccttgttgaaaagctttcatcgtttggctatcggaacaccacactcccctgtgttttctcccaatttattggcctctcttaaatctccttcttcatctccctattcctcttatgttgctgtgattcagtttaactcatagacctgttttctttctgtcacctcattgagcttcattactttaaacagtaccttcatgcatggcatttgttctttcagcctagaactctcacctaaattccaaactcctatgcctgtttccctacagcacatctcatacggatttccatttacatctgaaacatgccatgctcaacaccaaacttctggtctattctttctccccaccccacccccaaaactatctgtgcctgacacatatcccacatctcgtacattccagctttcttaccctagtttttaaggacaaaagccctggcaacaccactgactcaactctttctcccgttcctcatattgaatctctcaccatgaccactctagactgagccaccactatctctcatttgctcagtggattagattgtaccaagtaaaagaaaaagcctgagtgtctcacccactagacacactactgcaggtcccattctagtgtctctaaagaattgacaacttccttaaaaggaagtactcaggagccatattttaatgctcttaggaaaatatttccaagtggaaaatctttgtaataaaaattgagtctgtctttcagtttggacatatatctgtttaaaaagaatagcaacaaagttaatctttatttccctttcacaagtatattctaattggggaagctattgttctgatatgttaaagcaaaacattgctaaatggtacaaattctatgtgcttctccttttccagccaacacacatttggggaatattatatcactttcacgtttagctctcatcagcttctttcaagacctttaactattttacagacatatccagacaggtacaggttctgttccaatccctacaggtatgcatttaattatcactttaaattttaagacataaaaccagttatagagcagcgaagagataaaaagttttgagtgcaagaaatccccacaggagaggcatgttaacccttttactttctgaggtctcttttcagtagtgttggaatatttctttcagagccacgtgaaggggcaaggagccctgtcttccttctctccttgaggtgccattaattaactatgatttggccaggcgcagtggctcacgcctgtaatcccagcactttgggaggtcgagatgggtggatcacctgaagttagcagttcaagaccagcctggccaacatggtgaaaccccgtctctactaaaaatacaaaaattagctgggcatggtggcaggtgcctgtaatcccagctacttgggaggctgagtcaggagaatcgcttaaacctgggagacagacgttgcagtgagctgagaccgagccactgcactccagcctaggtgacagagtcagactctgtctcaaaaagaaaaaaaaaattaactatgattttaaaccactaaaacttccttctcatttaaggataagcctgtccaagcagggatgactgggccaagaaccttacattcgacacaggctcatcttttattccctgatgagggaagtaaaacctcctcctctgctctgtgtgctgtgacacagaataggtttagaagggaaaccctacaatacagcaggaaagaaatgtaactagaagctacaccacctggattttagatcttatactccactaaccaaccatgtgatcttggacaaataaatctcttctccttgtgtatgagtttccttgtccatcaagcttacctaatgaaattcacatctaacttcttctaaggactgttatgggaatcaaatctataagcctgaaagacatttcaaaatgcaaaatcgcaaagaaattacttgataattatatatgtagtaaagtgaaaacctccttttccttcccatttccaggctgagaaagactacttatctcaggatgcatattcatcccaaacaacttgtatttttacccttgattgatccctgaagccaataaggtttcagctttctatgacgttaacaggtactgcatacttccaatgttgacatccactgagttcttacttagtgttgagatttcatgaatcagaaacgtcaaagtcaaagatggcagctgttttaccagctgttttatccaatgctgacatccactgagttcttacttagggttgagatgccatgcatcagaaacgtcaaaatcaaagatgggagctgtttcattcagcaaggaggcaagtcataaacaatgatatatcaagtttcaccaaaactaagatcattaagaatgagaaataaataatgccatttaaaatttaagattccattgattgtgagaaaggaatgtttcaacctaggaaaatgtatattttgtatttggttaaaaaaagtttgtcatggtttttaagatttttgaaaataagagaacaggccgggtacggtggctcacgcctgtaatcccagcattttggaaggctgaggtgggcggatcacctgaggtcaggagttcgagaccagcctggacaagagggggaaaccccatctctactaaaaatacaaaaaataagctgggagtggtgatgcatgtctgtaatcccagctactcaagaggctgaggcaggagaatcgctcaaacccgggaggcagaggttgcagtgagccgagatcatgacactgcactccagcctgggcgacagagcaaacctctctcaaaaaaaaaaaaaaaaaaaaaaaaaaaaaaagaaagaaaagaaaagaacagtgataatggttagttaataaactgaacctacaaaacagaatctatttgcctatctatgtatctatgattacgtgccatgttccaaaaacttgatacatgaaaataaaatctcatataatccagaggactgctgaaatatctcaatttttttcctgttttgatacaaacatttaacttcttcatttaaaaaatgacatttattggccgggcaaggtggctcacgcctgtaatcccagcactttgggaggccaaggcgggcggatcacaaggtcaggagatggagaccatcctggccaacatggtgaaaccccgtctctactaaaaatacaaaaattagccgggcgtggtgatgcatgcttgtagtcccagctactcaggaggctgaggcaggagaattgctggaacctgggaggcagaggttgcagtaagctgagattgcgccactgcactccagcctggcaacagagcaagactccgtctcaaaaaagaaaaaaaagaaaaagaagaagacattattacctctgacattagcctaaaagtagcaaaagttaccgtgcaaattataacaaaatcggtaatcaaatgagaagtgagagagatcacgatatgagaatgaaatgaaccaattctaggtatgttgttattaacatgcctccaaaagtctcctccatgtaggaaaacttatttgtgattaaaattaccaagaacaatgttttatgtttagaaatgggtgctgataatacagattaagaagtaacagtactctaaatggtaagatgagttttgtaatataattatgactgttctttgttttattgttttttgttttgacacaggctcttactcttttgcccagtctggactgcaatggcatgatcatagctcattgcaaccttgaactcctggcctcaagcaatcctcctgcctcagcttcccaaagtgctgatattacaggcattagccactgtgcccagcctgttctttttcttggagcaggaattaaaaaactttttctataaagggccagatattagatattttcagctataagggccatataatgttacaagtactcaattctgttgttgtagcacaaaagcagccatggacaatatgtaaacaaaccagtgtggctgtgtttcaataaagttttatttataaaacaagaggcagaccagtttgccttgcgagtcatggtttgcaaacctatgccttagaagacaaataagctcagactgccctgcaggtaaacataccgggccgaacatgtctaacagtgtaattgtttccgttgaagaataatgtaatctagagtcccttctgggtctgaacttttacaaagggaaagcttagagtcatgacaatatggaattctgtgcattcttaacaaataatgtgagaatggggaggatgaacgggattgttttaggcctgtctccataagtgactaggcttaaaaatgctgaaacagccatcagtgttttcaaggttcagcctacttcaacacaatagtcagatacttactgcaaaataaaacagatgcaaaaaacacacagggacctaaaaacaatcaaagccactaaaatggaacatcaagtcttgagttatttaaccgttgggctgaagcaattcatcaaagctcctcacattaaatggcatctgttttccccacctttcaagtttcaattaacctttcatgccagaagggatcacattcaaacacctgagtcccattttaataaactggatttggttcagaacacctcacagttacctcagagaatggcaattacagaaacctgctcttgaatttgaaatttacaggaagaaaggtttcaaatgaccttcaattatatcttccttctcagcgatcagatgtaaaaatatcagcccagagtcactgatatttagggataataaatttataaaacaaacaccttgttcctcaagattctataaacaggtcaggagcagtggctcatgcctataataccagcaatttgggaggccaaggcaggcggatcacttgaggccaagagtttgagagctgcctggctaacacgcaaaactcctgtctctactaaaaatgtaaaaatcaactgagcatggtggtgcacgcctgtaattccacctatctgggaggctgaggcacgagaatcacttgaacccaggaggtggagggtgcagtgagccgagatcacgccactgcactccagcatgggaaaccgaaaaaaaaaaaagattctataaatatttatttttgtgcctatagatgtatagtttgtgtatggaatagggtagaaaattaaagttaagagcacaacagtcactccactagacagtgtgctctaattgtgttgacaaggattaccaatgcgggtaaaaattcagaataaatagttgattcagatacctcacagagctgtgacccacaagcctataacacataatacaaagtaaatatcattgtgttacttttgtacagcttgataagctctgtaccatgcacttacattcattatctattttaataaacaccgtgtaagatcaataggataaatccctcatttgaaaaatgaggttgaagacacaggttaattgatttaactgaattcatagagtaagttggttttgcagttaggattagaatcaagttaccatcattcacagctgagatctttcatccaggagaaaataagccccacaaaagctggaatttttgcgtgatttttttactgccacatctctaccaaactgcagggcacattataggtattcaaaaagttcatgttgaataaatgaatgaatagatatttttaaaatagttaaagtaggaacacagaaaaggtaaaagcagaacacaaacaaagacatgggatggcctcactctccttatccttgcagcaaatcaccagttttgtttatttctgctatgttttttctacatctcaaggggcccaaacccactatgacccctggtgattggccaagcggagttgaccaggaacaacactcagataatcagtgagggatcaaaagagggatcaaaatcaaggagttttagacccagtctttctacctggagggttgaccgttgacaagccattcgtctgaggagcctcaacttcccagtccttcctggcttccacacgtaactcttggggacttactatctgccttgcttaactacaggagtatgggaaaggtcaagtaagattatgaagatattttacacacaatacatattgatgaagccattattgtcctaattctgcattcattttctcagaataagatccagagtgaaacataggcaatgggattacactagcatttatttgctatagtggatgaagaccagaccaatgtctctggatccttggaagagttccctttcaccccccagttctgttcaaagataatccataacatcatttcattctgatgtcgggggcacctcttctggccaagaccctcaactgagctctcctgactgccaaaatggactcttttgactcattctctactattctccccaaaccttcagattctcctacttctcaagtccactgtccttggaatccttggaaccaggcagtctgcttggccttgtgtctggttacttctcagcagaatccaggctggtacagggcctgtgccccctgtattccatagggaagacagtccagtaaagcagatctccttttttgcactattggtgattttagacagtggtcctctaggacaatattacacattctcccaataaggatgatagagagatgaatgggtagatacaagggtggatggctggatggatgaatggatggatagatagacaaatagatatagatagataatagatagatggatagccggatggatggatagctggatggatggatggatgatggatggatggatggatggatggatggatggatggatggcttgctggctggctggctggatagatgaacagatagatactaatctaactaatagttagctgaagtaagatgcctcctgtacagttaaaagcgggcaagcattctgcccaggatatgaggaggaaccccgaggggaacaaagagatgaaaatatttgagaaacaccattagcaataatatgagtctcttctcccaaatggcatgaatacttcaaaagcatgtaaaaactactcagaatagctatgatgtaaggtgggagggtggtgacaatctatacctttagaaagcctgtagtcttccatctacacatcatatttttttttttggtctggttagccaataatgcaagcagtgggtagccaggttttaagaaggctctatattttttacatgaatttacgtatatccacacacacctgcagttaatgatctccccaagctgcagaagaataagaaggcccattcattcccatgaccccacgtaagcatagtcagatttgggtcaagtgttttaagtaccactgacgttctcctacctcacaaaagctttggcactggtgtttcctcaggtcccctgattccttgcagggctccaggcactggaagagaggaacaataaaaataaataaaacatggaaacaaacaaagctgagaggaaaaaagaattcacctgtgattgttgctttttcaatgcctgtttattctagttagtttagaaaaccaaagaatcagctgctctttttaactgggtataacacgaatctgagcaaaagcatcattacagaacgcggaccaaaaaatgtatttcaacacaattggaaaggaaaagttacagcgcccggcagtgacttacaggaaaagtaatgatcgtcaccatcagctggaggaattggggtaagacatattttctattcagtaagaaatattttcttttcttttcttttttttttttttttttttttgagacaaagtctcattcttgtccctaggctggagtgtgatggggcgatctcggctcactgcaacctccacctcccaggttcaagtgattcttctacctcagcctcccgagtagctgggattacaggcgcctgccaccacaccgggctaatttttgtatttttagtagagatggggtttcaccatgttggccaggctggtctcgaactcatgacctcaggtgatccacccgtctcagcctcccaaactgttgggattacaggcgtgagccactgcgcccagccaagaaatactttctaaaggttgttgtttcatgggatttttttcctcataaaagttaatattacatttcttttaaattggcagcatagggctattttttgtacactcttctacaagtgaaaatgcattgtattaaatttatgtctgtatgtatgtacacatatgtattattgttaacttgtgtccttatctcaatgaatccaacagcactcagatacatcgagtttaatcactccattaaaatacattgaataaatctgttagattatgacatgagagtctcataacagaaaataaggtttgcttaaacatacatgcatataacttattactatatacattctaataaatcaaagacactagccagactccattgttcaagaacgtttgtaataataaatagtaagattgttggataaacaaattatatgcacatataatatagtttattactaatatacactatatatattatatatacacacatgatatataaaatatatatactctgaggccaggtgtggtggctcaagcctgtaatgccagcactttgggaggctgaggtgtgcaaatcacttgaggccaagagtttgagaccagcctggccgacaaagtgaaaccccgtctctaccaaaaaatacaaaaattagcctggcattgtggcgcccacctgtagttccagctactcggaagactgaggcaggagaatcacttgaacccaggaggtagaggttgcagtgagccgagatcgggccactgcactccagcctgggtgacagagcaaaactctgtctcaaaaataaaaataaaaataaaaataaagcatatatagtgtgtacatacgggatgtctgtgtgtgcctgattgttagtagccaggcctcatggttgaaaaaaaaaatgttacattcatatgcatggaaacttgatcctcaaaattatatttaatgcaagttgtaattttaaacattaatagtcatatagtcagatgtcagtcatctaaatataagcatagccctagctctcatacattcatggttattttatctatattatttctatttcattattgatgagttttcaaatgacagtagaaattctcagttaaatttcagatatgtataatgtagaattccggatatatggtgaagcaatactacttttgcactctgttttctagtaatctcttccatgttttaaaatacagatacagttagaagatacactggaaaactctgaagaaacttaattttcaatatttgttgccatctttttatcaattatatgtatgaaatcaactgcccctgtgccaactgtcaattctttataacaataatgctcaaagtgtgatcaattactgatattatgggcatcctttggagtttgtgtgaaatgaaaattcatgggcctcattctcaacctacagtctgaatctctgggaccagggtccaggaatctattttaacaagttctactgaaaattctgatgcttagtaaactttaaaaagaactgccattggccgggcacggtggctcacacctgtagtcccagcactttgggaggccgaggcgggcagatcatgaggtcaggagatcgagaccatcctggctaacatggtgaaaacctgtctctactaaaaatacaaaaaattagctgggtgtggtggtgggcgcctgtagtcccagctacttgggaagccaaggcaggaaaattgcttgaactcaggaggcagaggttgcagtgagctgagatcatgccactgcactccagcctggatgacagagcaagactctgtctcaaaaaaaaaaaaaaaaaaaaaaaaaagaactgccaccaaatttgatgtttgcatttaacagtgtctttatggaataaatgcttgttggatgtttcttgagtgaaatgacaaagacttaccttgcaagtagctgaatctctgcccgtgaacaatccctagaccattactctttggagtaatgtctctttcttgcttcatataagtgccattaagaacatatatttctcataaaaaaatttttagatgtcatagtaatgttgcatatgaacattttaaattattttcatttttttaaaaaaacttgagctctttaataattcttttctaagacatatatgagcctgccccaagttacagtgcttacttctctcaagaatgttcaaaaacaaatttttcatcaatatagcaattctaaaagaaaaacaattttaatagtaatgaaacattgtttaaaaacttatctaaaggccgggcgcggtggctcacgcctgtaatcccagcactttggaaggccgaggcaggcggatcacaaggtcaggagatcgagaccattctggctaacacagtgaaaccctgtctctactaaaaatacaaaaaaaattatccaggcgtggtggcgggcgcctgtagtcctagcttctcgggaggctgaggcaggagaatggcgtgaacccgagaggcggagcttgcagtgagccgagatcacaccactgcactccagcctgggcgacagagtgatactccgtctcaaaaaaaaaaaaaaagaaaagaaaaaaacttatccaacttacttatgatttccttaaagaactagttttttgtttcctatggctacatcaatgctttgtcctcaaagctcttgttacttattttttctagacatttgcttcaaggcaaaaatgtttagtagttatttaaaagtatgctaagacctaattcttcctcaagaccatttgaaatgaatacatgacactcttgccactgcaaggtaagtctttatcatttcactcaagaaacacccaacaaacatttattccataaagacactgttaaatgctatgtggctaacaacgtctgaaaataagcatgtgatttttgttttctcttattgctaaaaatataaattataaaaatatgctgctacatgtgtacacagttgcattttcacaactatagatatcggtgcacaaaaagtctcaagcctttgaaatctccataatcccacataaccatggtcctgagagcttgtggaattgtcaaataccttatacaaaacaaatactatttacaaaaacaggcatatttctggaatgctaatcaaagcaatacacaacacacttgttttgctattaatccagaagctctgccaagtctagcatcagtatatgtcattcatttaaagctctattttaattgcattcctgcttcagatccagtaactagtaatcagcagtatctaaagacatttttcaaaatgttattaatgacagccaacattttcttttaataatcctccatgaaatctctctgacaagcacaacctatatacaatcatctgagtaaatgtttgcaggataagtttgccaaaagtctatttctttataatactctggccagttaaaaaaaaaaagatttcaacaaaagctaaagtgttgcgggagaaaacgacaatgacacactttctctcatacttcatgtagaacaaaaaacttcctatttctgcaagcaatttaaaaaaaaaaaaaggtatgtcaaaagactgcagccctgccagaggtgttagaacccaaaggactctatcttgaacaggggctgggtaaaatgaggccaagaactgctaggctgcattatcaggaggttaggcattcttagtcacaggatgagataagaggttggcaggactagttgcacaagatacaggtcacaaagaccccagtgatgaaacaggatgcagtaaagaagtcagtcaaaacccaccaaaaccaagatggcaaatgaaagcaacctctggttgtccatgtgctcattatgcactaattataaggcattagcatgctaaaagacactcccaccagtgccatgacagtttacaagtgccatggcaatgtccagaagctaccctatatggtctaaaagggggaggaaacctcagttccagaactccccacccttttcccagaaaactcataaataatctaccccttatttagcatataatctagaaataatgataagtttactcaatcaagcagcccatgccattgctctgcctatggcacagccacccttttattcctttactttcttaataaacttgctttcactttactctgtagccttgctcttgaattccttcctgcatgaagccaagaacccatgtggcctcccagactgaactccaattttggggtttaccttgtgacaaccccacatctctcttccacgagaggagtgattatgagagaaatactactaccaggagacaattgctttagaatgtattacataaactcctataggcgccatgatcatgtactgcctaaaactatccaaaacagtaaccaaagtttatatttttagcaaaggttttaggctttcaagttttaggatgatagactaaaatcatttcttccgaggctactgcttcaattccaatgaagaaacactttaaatttcaaagaaaaatatgtagattgagagagctaatcgcatatgtcatcgtttggcaggtagatactaagtatgtttctacttaacatagaaactttacagattacagaccacttttaaaactatttgtctagtggagcctcatcacaacacatctatagaagtatgtaaaattatgcactattggctgggaatggtggctcatgtctgtaaccccagcactttgggaggctgagatgagatgatctcttgagcccagaagttcaagaatagactgagcaacatagtgagactttgtctccactaaaaattaaaaaactagctgggcatagtagtgtgcacctgtagtcccagctattcaggaggttgaggtgggaggatcacttaagcccggaagtttgagactgcagaatgcaccactgcactctgcagcctgggtaacagagtaagactctgtctcaaaaaagaaaaaaaaattttaaaaagggcacaattattcttacattttagagaggaaacactgaagttaagagaggttaaggaaacaaagctagtgactctgggagagattggggcaattgggattgaacccatgctttagcacactcaaataaagggtattttccatgataaagcactttatgccacttgctacaggggattcatgagacaatgtatataaaagatatctgtacactgaaaagtactttgcaaatccatgggattagtaaactatggtgctcccagatctctctgggattcagttccagaatgccctaggtgttacgcattccaagaccttcatataagcacaaccaataagactatttcatgtcacagagagagacctccaactcatgagtggaagtactgatcaacaaggaaattgtggatactactttgtgaatcaccacctggccagtttggcaccaaattccatactttacatttaaccaaacactttcataaaaggacagcagaagaaatgttcttaccaaaacagccatcacaataaattctaaagcaaaaaaggttcacacgaaattcaaaattttacattatccaataatcaacaagtggaactcgtgatcagattatgctaaatgaatagaacccatgctaaaacaaagaagcagcaggtccatagatttcaatctgttcgaattagcaacaaattagctaaatcaacaatatggattaatatttctaatgtgcaaagtacttatctagtcaccaagacagggggaaatgtggcatgattcattctgccctgagggagcatggaatctcttatgggagaaaagtatgtagataaataagtccgcatcagtgaatcataaaataaacgagttaagaacgacatgccggccaggcgtggtggctcatgcctgtaatcccaacactttgggagggtgaggtgggcagatcacttgaggtcaagagctcgagaccagcctgaccaacatgatgaaaccctgtctctaccaaaaaatacaaaaattaggcaggtgtggtggcaagcgcctgtaatcccagctacttgggaggctgaggtgggagaattgcttgaacctgggagctggaagttgcgtgagctgaaattgtgccactgcactacagcctgggtgacagagtaagcctccatctcataaataaataaataaacaaacaaaaccaaaaaaaagtcataagaaatgaaaaaaaggatatgtattttcatagaggatcattgaaaagaacttcacagaactagggacccataaatcagcttagaagggtgactgtgactagaacttgaccagctgtaagtaaatttgggataaggataatattgaatgtatggagtggggagtatggtgtctgattgctagtaggagaaaacacatagcagaaaacaaggctggaaggatagcccttggattcaatgaggagccactgacacactcagaactaattgtttgttccaacttgtgtttatgaagacttgggtgttggaacagaagatggattagagaggtgagacattgcagtaaagtaaaccagagcaaaagtctttacaacgtcttccaatcttctgtctgccatttctagtgtcagtatgccaccagggtgtcagaggacattgggtgaaaggaggaaaaggatgttaacctatgaaagggaatatggaagtgcaatctcatcaacatggttaccaatttgttttgagaagtggggatgagagaaatcaaatggggaaaggcaccaaagtttccaatctagatctcaagggaactgatggtgtcaccaagacgaaggaagaaggagaaacaagcatggggaaagatacggaactgagtgcttaacacagcgagttagaggtgtccagggtacgtacaaggagtgttgtccaacaagctattgaaattgtggatatgcagtttaggataaaggttaaagctaatgatggcatttataagtttcttttgtctttctctctcatcattaatttattccttttacaaccatttcctgagttctaactataaccacagtatcatgctaagtgatgggcctatggctaaatctatgaactacacaagggactgccttcaaggaccttaagtctctacaaagatcatagcatgtacatttacaagcaaacgtcaaagatacagataaagaggtacagacaaaattaaattggagtgtcaaaaattttaggagttgggctatgcgaaaactagaatggcaacctgtatgagatttcatggtttagtaaagtttttttttctttaatctgttttgttctctctttacgtgtttgtgcttcaaaatgaggtgactggaacacgttaataggcagaaaacaaaggatcaaacggaggaagtctgactgaagatcaggatgattgaagatgtagaagaagtaggaaattatcaattgatcaaggtcccagagactgttgtaggggttacaatatgaaaacaatgaattttagagaggcaacgtatcactcctatcattgaacccaaccctatacagcttccagatttgaaaactgaaacattttcacagaggcaacggccaagtggtagggtttagatccatggctctgcctaggactggacatgaacgtacagtttcactccagcttagaggatgtaagcatttggatgtagggaaatgtgacaatgatcatgtggcatgttgataacctgtgtgaataagccacaggtttccaatatggtgggaaggcactgatgtttagatgtgtgtgccttcgtggatgcaattctggtggctgggctttagtagtcttgaatggatagataagtcaggccacttcccaggtgagggactctgaaactcatgattctagccaagtctgaaggcaaccaaaagagcactgagttttagatttggactgacccagaggagaatccctcatctacctcaagctaaatgattttttcccattcaagttttattttaacctctctcaactatacgtttctgatacataaaacagtgaaaaaatatttgctcaggtggacttttttcaaatgaaatttataaagaccaccttttaaggtgtctacacatagtaggtacttagtgaatctagttctcttccatttctaggggaccaataaggagactttattttatagttctttcatatttccctaatgcctacctacattttcccttttaattggaaaagaaattcaaatttctcttaattccagtctctcaagcatgttctaataattgtttttaaagtgccacatttcttgcccacatttccaaaagctaagattgaatggtgtggtaatattctgtgtgtggccagaacatggaatgagaagggatatcctgagaccatagcccagtaccttttctttcacaaaagtattttctgttgaataattaaaaaatcaaataatgccttatacttaattttgtctggagtattgcctggatataaagaataagccttggggttcttaaaaaaaaaaaacctccaactttttattttatatgggtatacattcatatcatataacaatgctatctacaaaagtttgcaaagaccatttctgttttctgaattaatggcagcaagtttctctaaaaagctgtggacctgctttttagatgaaagctgtttttttctcccaaatatatttcctaaaatatgtgcaccctactgcctttagaagtattcatggcctccctccagctctaaattggtactgtatagaaattgttacaatcctgtgtgtcgaaaagtgcactgtgtcttgccaaaataatgaaatcttttggcagacagccctctgaagtgcagttgaacaatcattgcagcctcaatcacagaggattagcatgccagcctagcacaaccacaacagcatcaggcctgagacgttcgcatcacaaatcaacttgctctgaaacgtccgaagggcaatgactctctcactgcgaaacttatcaggaaacacgggcctcattttatcacaactactttttcacaacaaagggagtccttggagtttcgggggaagtgtttagaaactacataagtaaatgagaggaaagcaatcagaaaaccatactctcagtgtaattcttttccacttaattaagtttcttgaagtagacaaagtcatggaattctcttacctggaagacaaagcataccttctttgcattcctatttttcaaccgcaatcttctaatatggcatttttggtacagtattgaagcttcaaatagtattcccatggtcactgctcaaatttaaaagatattaattatgaagagaaagtgctaactttccagtgtagaaacctagcagagcgcaccttaacaaaaggatcaaagatattgcctccaagaatgggggaaaaaagcaaaacgaaactcaggtgtctcctgaaaggatgcactagcaaggactcagcatctcacagaggcaggattcctgcccattatagagaacctgaatctaaccaagaggaaataccaaacaatctacaaagcaattagcctctagtcttcaaaaatatcaatgtcctgaaagacaaagaaagactgaggaatggttccagaccaaaggagactaaagatacatgacaacaaatgccacacataatgaagaattggatcctgaatcagacaaaataaggctataaagaacattatcgggacaatcagtgaagtttaaatataaaccgtagattagatgttggcgttacatcaatgttaaatcacctacacttgataattttatcaaatgatgttggtattatatcagtgttatcacttacatttgataattccattctcttagtagattctcttagtagttactaagagaatgcacttgttcttaagaaatgcatgcttaattacttggaggtaaagaatcatgatgcctgcatcttcttttcaaatgattggaaaaaaatgattataagtgtatgtgtgtgtatatatacacatagtatatatgtatacgttatacatttgtgtatatatacatatatgtatatgcagagagagagaatatgatgaagcaaatatagccaaaaaaaagaaaaagaaaaggaaaaaaaggaaaggtaacgactggtaagtctagattgggtcaagcaactagaaaccagggaccaaatgtggcccacctcttgtttttgtaaataaagttttattggaacagagccatgtctgttcatttacatattgcctgtggctgcttttgcactacagcagcagagttgagtagttgcaacagatgaccaagccagcaaagaatatttataaatctttgacagagagcttgcaataccctgatttagatgaaaagtatatggaagttctttgcagtgttctcataacttaagtgtgttttttaaagttaaaataaaaaataaattcataaaataatcttaaaattatttaaaatctcaaatcacaagttttctctagctggcattattaaaaagctattatggatataaatctatgggcagagagcattaaaaaatttaagttcctatcaatgggcttataggaataaacagatttaaagacaaatgcttcagatctgaaacctcataccaaatagatgatatgtcttcccaagcaactgttcaagaagaaagagacaaaacctagaatcttttaggctctgtaaagtcagtttcaataggctgtataaactggtggtttaaccacagcctcagaaaccctaaagtagaggacccagcatagcctcagtcatcttggaagtcccaggtaagctccagggtgactctgtaaggatcccaattgtccttcctctctgccatcacttctaattacaaaacacaggaaacgaggtcactcagcactgtggtccaatttgcctcttggaccctctgtgtccctccctcctttatactagataagtccttcttacaacatccaagcacgatgttcctcacaacgaagataggagatggatagaacctacttcttttgcagttgcaaactactgcatggcatgtcctagataagtattagttttcagtagtatgttcactccctggctacattcatacatgaattctaaaatcagcagaatcagtctgtgtttattaaaagtccaatgaaggaaaactgatgttggtgttttgccaagacagagcagtaaaggaggggtaggtgtcctttcctcacaggaggaagcttacatcctcacatgaacattttcctaaagacacaaaaaaactcaccctcagtgggaagtttactggcgcacagacagcttaataaaatgatatacataacaagacagccttttctctgggaaaataaaaatgcatatttaatcaaagtgctaaaaaatcagtaagggctagaaactattatctgtacatgtaatttccaacccagaaagtgtaacacacacacagacacacaattttttaaaattataatctgattataggacatctgtatatccttcggcagactatcaaatccatcgctcagctttctccaatactgacccccaggtaatcaaaataactcaagaatcctggcagagccattagccaggttttacaggctgaattaacgggatccatgttgtgcgtccagaatctcaagtgttcattagatcagattttgcgtaactcaactggaatcaccagtcacagcattcgaagaacttaaacagccaggcccgtctccccagtgaaggtcagaattgaatctgcacagcatgattctgacatcactgtgctgcaaggttaaaaaaaaaactgtgacaagttgaatggagattaggatttccctcacttggtgctatgtttaaaagcttatgctcatctagctctgatccttatctccatatatatttttttcctacacattttcttgacaacacacatctcctaagaaaacatttgattggtagtcctggagaaccatgtcaatcttattcccaagttgggtggcctggtgtcctttcttcctgtgctaatgaccttacaaaatgcggcatacatcacaggaggaatgggattttgctctttgtccctgtgttaaatctcacagagctacttataagcctgtcttatttataatatctgcttcttgcttaacaagattgtttatatcagtaatatataagaatgccatgggtaactatatgctgttggcttattgtttccaataaatgcatctctttgtctgagaggtgagtgattatagtaggttctaagagagaacctaaaatgaagcatgtctgtgcagtgagaccaatcagcaacagtgtcaacactaatcctcttctgatagaaggagcttgtaacactgacagcttaatatctatctgtgtggcttggttgtctgatatgtcaaactcaaggaaggcatggtgtgctcttgaaaagaccagggagccaaatctcatggggactttcatgtttcctgtctcccttgccagatcaaatcaccccagctttgtcaacatgaaagctcctctaagacattagtgcatccctgagcaaactcattcaatttggcattatgtggtaggtctgctccagattaatgagttagacatcatattcataacttttcagatgcttaaaaggaaacaccatggtggagaatgtatgttagttatggatggaaaactccgtttataatagaacctgtttggcctttaacccaaacttgaaatttgtacaacctcacttgaatatttaattttattctctcttcaccacaaaaagagtgatgttgaagttcttgtggccaatggaattccatcataatacagtaacaatgaaagctatttgtgaactcaaccaaaacgagcagcaagcactaactcagtaagtttggatcatgaaggtttgtttaactactgcagtctttcaagagattttgcacagggtttagaagagcctccttcatactgtgggcaatgcaaatgtcagtttcttgtgcttgttttcccttgttatccccttgactgaaatacacatttaaggactcaaccaaagatgtctcttcctcttgttgttttgcattttacaacttagctaactgaacactgttttgattaactctaagcttaccttcattacccctttacccattcattcatcagctgctctgctgaaccaaaaaaatgcagaaaaaagaaaaaaggagtagctcacattacctagaccagtggtgtccaacataatgcaagaatggaattgttctacatgtacaccatccaatatggcagccagcagccacatggggctactgagcacttgaaatgtggccaatgaggctgaaagatgaaatattcaattttaataaatttaaatctataaagctatatggctggtagctaccatattggagagaagaaactgaaaaagttaaaaggaaagtacaaaagtatgcattcaacatccatcacacccaccttccagtggaagaggaagtagaagctgcatttcccagatgatcatgccactgaaattctgaattcaattaggttatgctcatcaatatatttacgcagcatttgaaggcaaaaagaaaacagaagatattttcttgcttgtgccttgttcactatttctgtggtttagaacccttgtgaaaatgtgagggttttctgctgcagtcttcaagtcttcattctccagcttcctgggtatctgtagaggcttcatcaggggatggcccttgactctcacattgttactccagagagggctcagagcaagcaggagagtcagctctctgttttagagtcacttctggaggctgagcctagagtccattccttcaacacctctaatcattttagaagcatctaatcccttgtattaagttccttctagtttatgtacctagagtagtttgttttcttcactgacactacctgatgaaagcaactaagatgatacatgtgaactgaaattttttaacccttgtgacatcaaaaatgcaaagaatgtagccataacttttctgattatctattgtgtcaccaatatcatttctaatcttacaagagtctccctttactttgtaacctccctctctaccttctctgcgtatgtatttattgattcacatctatgcattgggcaatccaagagatattaggagcacgtggatgcatcaaacacacagtctgcatgctttgaccttagaatatgatggagaacaaaattaagccattacaatacagtgggatcaaagccgtgagacaaaggcgtacagaagtacagatggggagaacctaacccaagtgacaactatgcaaaattccctgggcaaagggatatgtctaggcagaaaacaaaataatgagtaggattaaccaggcaaaagcaggtgggatgagagaagagtatgttccagatagatttgatctttttaagcatgaaaataaaactgtaaattttagcaacatagaggcactccagaggtttctgctgtgttctgagatgaagacaaatgatctataattcacaggctatttagagtcaactttagctttgggacaagtgggagcttggatcttagcaatgcttagagcgactgctggatatgtttttagaagtatagcaggctttatgtagaccagtagaacaaagaaaagaaaatgattcttattgaagacatgtacgtttcctttatcagagagaaaggacctagctttcctttccccaaagcatgcataccactggtaaaacgagtaatctaattacttcaaaaagacagcactcgaaggtctgctttatcaaatgataagattccctaagtgaaattctaatgcacctgaaaataacttatataagaacatcatttttataacagacatgtgatatttacaatatagatgatgccattcatgcctgctttcttccacttggggggagcttaaaaagaatctcactcacacatgaaatcattttggagatttaaaataaagtgtacaaatcccacaaatttaaataggcagcttaatgtaatttaatgccactacatgtaacagtttaactggacaagaacacacagaaggaagagtaattattttccatgttttattagtttctttccaactcattcagattgttatacatatatcaattcataagagtaacttaaataccctgtatcctcagaaaactgtttcaccaagatgctgctgataatgtaccctcacttcaccaagaggaaacagatttgctttatttctaatgtcactgaatgtacgtttataatttacagaatgcttctcttctgcttctttactataatagaaatgtattcatgtttatagaaaaacaagaaactcatatccaacttactcattttaaagaggaaatgtgatagactaacatgcaaagaatatattacaaagagaatacaaggcaaaaatatcagaatggcatcttctgttggaaatagaggatactaaatatttttggaggttacacatctgtcagatataaggcaagtccttcccatgaagtgataagcttctctctctttctttgggaaatgtacttgctgttgctctttgttaatgagcaaaatcagtgacccctctagctcagaaaagactcctgatcactgcctccaccgcatccccacccagaggactaaatgaaccagtgacaacaaaatgctcttgtgccctaggccctctatttctcggagtttatagaccacctaacaatcaaagcagggcagtagggggaggccgtctttgtccctgctgttactttgtgttttttctcgctggcttcccagtcccctccgggcaccatcatcaccatatccctcatggctaagcagccagaggcatggggctttcactccaaatttcacggcatgatgaaatgcaggggctgcctctctggggatctcaaagccctcctttgtgggcctagttgagggtcaggttaagtagcacattttggcagcaggcatctgtttgtcttcacgccatgatcttcctaacaagggggagggagaggaagggaagcgggaagaggagagacagtttcagaaaaccaccttcacagtggcaagcaaattcccttcagcggcttgacagactatgaggccaatgtaaatccaatgcctaccacactgatggccccaccgaatcaattcgattgagccgtgagacagggagcttttcctttcttataggctgaggcctcacttgttgctctaaagagaaaaaacaaagcaagaccctttcttgctcagactttttataaagaaaatgaacctgtacaaaaaaaaaaaaaaaactgttggaaaggtcgcatttcttgttttttttttctcttgtaatataatcatagaattttaaaattaattcttctcaatacagaaaccctgttgctataattgggagacattgctactcaaggcaaataaagagctcattctatttaaagaaagcctttatgtagaaaagctttacaagacatgattaatattaattatttctacaagtcatagatacaatttctactctggaaagaaaccagtgggtagggattgttccctaaaaactcaaaccactgaatatgaccaaagtcaatagttcaaaagtagagttggttttctaatataattaaaacccacatatcaatgttttctcagaaaacagaattatacttcgttccctgtgtcattctctaagaatagatacttacttcctcatgtcagcctatatgcaagaagaataagccttttaaaatgatgagaaaattagtaggaaatgataaatgagaaataagtaggtcagtcagatgtatggagtatccggaagagtaaggaatatcacaggggattcgaaagcaataaaaaataacatacttcatgaatctgaagaatcattgtaaaaatcatcagatgcagacagacacacacatgcatgcacatacacacagcacaaagaaactaaagcataaattgccaactatctagctcacccttggtaaaggagggaataatcagatgtgcagaaagagggaaaaggaggtatcacatgatataaaacagcattcctcacattcatcttctcattaaaccattatttatttctgtgatcccttttttcttcagcaaagtggatgatattattccatcaatattttaaaaagaaaaacagtatccactggagaatcagcttctttagcaattgtcaccattgctccattacactatcacacacacaaaaattcaagacctgcacatcaggagatggaaatgcaaattacactggtgtgcatacacacacaaatacaaaggctatcttattggaagtcttcatggatttcttaaagcgcatgggaatattatgtcaaatattaaatacacaccatagtcagtttggcacatgaaagtaaagtcattccaaggtaatgatttaaaattgtgtggtgtttaggtagtctgctcatcttttctaaaaagtattcatcaaaattccccgaaaactgatttaagattaatgcttagagttctagataggcatccattctgccgggtttttttccccctgttgtctgggattttattttattaggtcaggggtttgcaataggggcaaaggaagagacacagagtttattttaatattgtaatgtaattctagagtaaattagtaaagttttatgtataaaatctcagaataaaataaatacaacatatttataattctatccataccattaagacttgtacacaaatgctccttacagcattattcataatagccaaaaagtggaagcaaatttcatatataattactgacgaatgaatgaataaataaaatgaaaaaagaatacatggaaatattgtttagcaatgaaaagaaatggaatactaaagcatgctacagcatcaatgggcctttataatattatgctaagtaaaataaaaagccagataaaaagattacatgctgtatgattccatcatttatatgaaatgtctagaatgagtcaatctatgtagggaaagaaaatagattagtggatatgtaggactgaaggaattggagggaaagggaagcgactgccaatggctatgggatttttttgggggtagtgataaaaatattctataattctgctgataattgcaagactataaatacatgaaaaaccaatgaactatttaaacaagtaaattgtacagcatgtgaattatatttcaagaatgttattaggcaaaaaaaaaaagtttctaaattcaccagtatatatatgtaatttatattgaacaataattaaaaatgtactgactttccctgtcaaatagattgtaagttaaaaattcagtgatcttcaactatcccattttgaatagattcatattgtcaaacatgtctattccattcaatggactaagcacatggatcggtatctcttaaagtgtgggtttggtcctcccctctcccacactccaccaagattaggattgagtaggtttgaagttgcagccagaaaaatgcatccatgggcaccccaggtgatcttgatgcaggctgaatttgagagtcatgagccatatagcagcaattacttcaaattacatgaagtctgagaatagatcatcaacacataaaaatggaaaactttataaagaactttcaatgcctcctctttcgtgttagtttttgaataataatttttcatgcaacataaccattcaaaagcaataattctagaaactgttagacagcaattacattaacttaaggtttatgagtcaattgaaacacatttttttctaggtgttgatgacctagaggaaaatgaccacttgaaaaattaaaaacttagagacatatcaatgaaagaattggcactcagtgaactcctaataatgcatatagaaggtctttattgaataaaatagaagtgtttgcaactcagaatcatctactctttttaaatgtcaatttaacaaaataatgtatcatttaaagatctggtgactaaaattttcagtataaatcatgtgttgcattaataagttgggccctttcattttgtgttatgctgttgttccattctacttgaggactaagctctgattctttcatgttgtccaaattcctatctaaggggtctagggagtcatgccctacaaaccataagttctcattagatgggctttatttaactctatatatcatgacttattttgcaacgtgactctggcataacattacgagacaaggaagaaaatcaaaatattttacccccaaaatatgttttttgttacattttgaaatggtcctgcaagccatcctttgtgaggaaaaatgcacatctgtaaagaatccctattaacatagctagaccttttccttccagtctaccaccttttaaagggtctgaataggaaacatttgtcatctattgtttctaacagcagccactgtgagacttcaaaagaactttggtctcctcaatcttttatcttaacctgaacatttcctttccattgatcccaggtctttagacaaaaactcagccaactgtccatcagaaaatgtttaaatttacctataacctagaagtgccacccccccaaccccgcctccactttgagttgttccgcctttctgaaccaaaccaatgtctttcttaaatgtatttgattgatatctcatgcctccctaaaatgtataaaaccaagctgtgccccgaccaccttggacacatattctaaggaccttctgagggctgcgtcatgggccatggtcactcatatttgactcagaataaatctcttcaaatattctacagagtttgactcttttcgtcgacatacttgtgtttaagatttagcttgacgaaaataccgttatgcagaggaccattcagcctgtaaagtaaaaataaagtaataaagttctaagcctccactcaatggaccccatcttagccaaggggtcccaaataaacctgaaaaattagttcaagccatgacaggaaagaagggacagacatgcctccttcctttggagtttaggcacaactgaccagcattcacattagcatagggatcttaagactgacaaaacagactctttgtagcaataagatacccaactccaacctgaccgtagtatagcatcacatgacagatagcaggccctgaaaaaaaaaaaagtattttacctcaaaatatatttctttgacatattctgagatagccttgcaaagccatctcttgtggggaaaatttgcattctgtagagaatcgccttcccttattagttcttttccagagaatctgacaccttttaaggtccaataagaggtatttaccatctattctctctgaagcctgctacctggaggcttcacctacatgacaagaaccttggcttcttcaaccccactgtccttatcttaactcaagcatttctttctgctgacttcaacatttcaggcagagcttaactctttcaaccaatcgccaatcaggaaatctttgaacccacctatgacctggaagccctctgctttgaaatgtcctgccctttcaggctgaaccaatgtatatcttccatgtattcatttacatctttgcttgtaacttctttttccctaaaatgtactgagaagctgcaacccagctaccttgggcacatgttctcaggaccttctgaggccctatcataggccacggtccttaactttggcagaataaacctctacattgattgagacctgtctccaatacttattggtttacaaaccttaacattatattagatgggtttcccatgtgtaatttcaaaatgcaatgctttcactgtaaaagaactcagctgcaaacacatgcccctcaataggcagctcaaagttcctccagggagaagcactgaggcagaggtgaagctaggagctgagtgcaacatcgacgaagggagtccaggcatcctgttgtccagcaggaggggaaatggccatgtctcagcagaaagaggaaccaaagagctttctgcaggtgtcggcagaatgtgaattgacaaagattctcaacttcacctttctgaagaaatacttctcgtgtggcccctcagaccccaggctcaaaacacacacacctttcagtcaacctgatttcagcaaatatcctaccctaacatagcagtagatttacctgtctggacttttgtttttactattacttcccctcttcatatttctccactcttcttctgaatgtgttctctttaagctttgttgttgttgctgttgtttccatttatttttatttttagtttcagtttagtttagttttgttttgagacagggtttcactcctgttgcccatgctggagttcagtggtgcaatcttggttcactgcagcctcaacttcccaggctcaagcgattctcccacctcagccttctcaggaactgggactataggaaaatatgaatagattcatattgtcaaactaaggcgcctgccaccgcgcccagctaatttttttgtgtttttagtagagacagggtttcaacgtggtctcgatctcctgacctcgtgatccgcccgcctcggcctcccaaagtgctgggattacaggcgtgagccaccactcctggctgtgtctgggtaatttttgtatttttgtagagatggggtttcacaatgttggccaggctggtcttgaactcctgacctcaggtgatccaccccctcccccctcagcctcccaaagtgctgggattacaggcgtgagccaccgtgctgggacaattttattcttttaggttaataataaagagcgaaaggaaagatggtgagtctagcaacaaggcaataaacataggacagtcaaggaagacatctttttttgagacatggttttactcctgtcacccaggctggagttcagtggcgcgacctcagctcactgcagccttgacccgccaggctcaagcgattctcccatctcagcttcctgagtagctgggactatcggtgcgtgccatcacctgtaataggcatgccatcacctgtagtagccgccacctgtagtaggcagataaagtaggattttgtgggcctagtgattttggaaaccatagctaggcctttaaagtcctttgagaattgctacattgaagtgatactgtatttctcagcatgaaaataaatgtgaacgctaacactcattttccatcttttcatggctgcaatagaaagcttcatgtattttgtagattacaattataagtaaaggctaatccccttccctgccaaaagggggaaggcttgagaataaaatcctgtttcaaaagaagatttctggaccggcgtggtggctcacatctgtaaccccagcactttgggaggctgcagcgggtggattgctttgaggtcaggagttcaagacgagcttggccaacatcatgaaaccctacctctactaaaaatacaaaaattagcttggcgtggtggtgcacgcctgtaatcccagctacttgggaggctaaggcaggaggattacttgaacccaggaggtggaggttatagtgagtcgacattgcaccactgcactccaccctgggctacagagtgcgaacctgtctcaaaaaaaaaaaaaaaaaaaagaagatttcacagggcacttgcatgctaccaatgagatcgaggtggagggtccgatccttgtctagggtacaatttgtcgtgagcatagaacgctttgttctaccatcaaaggcagaaatgtactattcatcttgtataggcagggtgtctcagcctccacgctactgacatgcagggcttatccataagcctttgttgtggggggcagttctgtgcattggaggatattagcaacttcgatgctagtagcacttccatcctcaggtgtgaaagcccgaaatgtctcaaaacattgccaaatgccccccagggacaagaactgcccccgggttgagaaccagtgatatagggtacatgcttataaataaataagcacgaaaccatcaccaccatagggaaaggcattcagaacaagtctttctggttatgactcagaaccctcatctccacaatattgatttcccaatcacacagtccagatggaaattctaagaaagggctaactcacgtaggctaggagagaagcaattcactgtcaccgcaattcaaaggatgatagaaaagagcaagcaaaatatatagcaagtcgcactaacacttgaaaataacttgagagctttcaaacaattcccacaaatccaaactgctttgaagcatatttctatgataattctggaatctttatgtaaaaaaaaagtgaactcttagcttttgagtgagttgagtgtattgccagcttagaaactattttagagacatttttcctcttagctacaagcagtaagcaagtgcacttcgtatgttcaatctccttaagaaaagacctgggacttcattagggtgagtgacagaggagaaaatgaatcgtttgagccaaaaaagcatcttaaacctataccttttaataatttctcatttcaacaccctgacatgctctatgcagcttgggcatctcattagggacaaataatatcatcagaacttcccatctccacaaagcatttgaaatccagtgagtttattaaatggcatagtgttataaattgataaatgttataaatttataaactgtataaatgttataaattgataaactgtacaaatattataaattgatagacaaaacaattaaaataatgcttccaggatgaactaatcttcgtagtggaaaacaatttatatgcctccaaagtgaaccaatatgatatattaaaatagaacaattggccaggcgtagttgctcatgcctgtaatcccagcactttgggaggccaaggcaggtggatcacctgaagtcaggagttccagacaagcctggccaacatggtgaaacccagtctgtactaaaagtacaaaaattagccgggcatggtggtgggtgcttgtaatcccagctacttgggaggctgaggcaggaaaattgcttaaacctgggaggccgaggttgcagtcagctgaaatcgtgccactgtactccagcctgggggacaaggcaaaattccgtcaaaaaaaaaaaaaaaaaagaacaattacatggaaattattgtgtaactgaggaaacaaatttaactggatgaagtaaatgccacaaaaatgcaataaacactcaaataactatttgccataaatctagtctaaaataatgacaatcatttaaaaattgctgtatctaagttgaggagttaaaaattgtttgtgttaatttttaattctttatatttggactattgttcataaaagtaatatcatagaaattacacttattatcaaatagcaatattattttaacaatgctttcatgaatctccaaaaggtccacatatgctattaaatagccagttttgacatatatactttctatctttctataattccgttgatgtctttgttcagtaaatgcaaagattagtcctgtgggatgttaaagaacactaccagcatcaggtgcactctaggtgtttagtaaagaaaaattgaatccaagagagaatagccacttagacaccttttctttgatataaaggaccaataaacggacagtctccccaggcagcatctcctttatcagcctccattaaaatggttccaatacagaaaggtgttaagaagtgaaaatccactagacatacgcttcactaccctcgtctacagctcccccaggaacgatacccaaattcctttagtgcccagagtattcacaaaagggccggtcctgacctccaagatgtttcataaattataaagtcaaatctattgtctacatctctgatggtgagaggcaggtatggatggaagcattgagggaaaacaaaatgtcagggtttattaaccccaagtaagagcgagaagagtcccatttttactgctgaggattttatgacccagggagttgacatacgtgactatgtctagggcaatatatcttgatagtgacaaagctagaacttgaagatatgtctcatcatggccagcccaccatcatccccagggattcaccaatgagccatcttatcaacatggtccacagaggtgggacctaccattaccattcccatctcctcctctgctttatttgttgccatacgccttattatcctcttatatcaatgaggacaagacttttgtctttgtccatatcagtatccccaagaacactttgcataagcaataggtattcagtgaacgaatacaacaataaaattgcatcaacctgagtcttaacatgtccaagttccccaatttaaaatttctcaacaatggtaacaatcatctcaaattttgcctgcataaaatggtgctccaacaagtcccatccacttctcagctacatcttctgggtgcaacagcctgctgagccccaatctgggggttgcagtggatttcccaggaagccaatcaagttcaaggtggcccctcacttgtaggagccccttccatggcactggaagagacccaggaaatgtgttcacatgcaaattataaaatttgcaaaattaacctattttctttttgttaaactacataagcttgcatctcacatgcctaaatcctgtagaagtgacaggctttatatttgacaatgacttgcccagtgttacttgtgtctactgcttatgatagtttcctgggggacccataagtagtgtaatcctcttgagacttgcaactttttctggaggttccagttctcctgggtccctcctggcatttccaggcaactgcagaacactgcagtgtccctgagctttgctaaaccattgctttggaatgtgctgataaacacatctgctggtgcatttcccattttctgtttctgaggagatcctgaagccttcttggataatcaggaggagaatctgaacatgtcaaatcacatgtatttgtaaatgagaacagcatggtcagaaatcagagctagaagatgggttaaatagaacaacagtaggcgtttcaagaggatagcaaaaaaagagagggttgaagatatcctactataaaatatcatctgaaaaagataaacaggctaggccaaggtgggcggatcacttgaagtcaggagttcaagactagcctgaccaacatggtgaaacgtcgtctctactagaaatacaaaaatgagctgggaatggtggcggacgtctgtaatcccagctactcaggaagctgaggcaggagaatcttttgagcccgggagacggtggtggcagtgagctgagatagcgccactgcactccagtccaggcaacagagtgagtgagactccatttcaaaaaaagatacaggggctgatgagaatgaattatcgcccacaggaggctgtccttttgaccacactgctgaatcaaagtcaaaggagaggtgtagacagggggaaacaaaatccaatttgtagtcacagagggagtactgggtgaaaaacattttgaaaaggagtcggggctcaacagaactagtttatcaatgaaagacatttcaaagccttgaaagaaaaattactaatgcccattgctaattaatcattctacagattctcatgcaaatgttctttggatggctttgatctgcactgacacctgaaagaaagcacacagtgtctccggacgggagcgatgcctgggaggcaatggcatgtgtgggtacacagccccctgtatgatcccctaataccctgggaactctggagccgctgagggcggccaagccacagaaagcagggctccagcctagcccatgctaggacctcagagatggctccactgtggccctttacctcccaaaccacaaaacacaccctgatcaaaagcagatggccttcccatgccctcgtccttaacaccaatgcaaatcgcctcccagaactgttcaatactcccatactcactgaaaggagaactgaatacgttaaggtcttgaagaattggggagaaaaatgttaaataaaattaactagatattggcaaagtaacaaaactgttacctcatcgatgggggaaaaaaaagactacttggggaaaattaaagagaaatcctttttcaaagctatgttctcaccaatgggtagccaagtgtcttcaatttcgtagtcttacctgatttataacaggagtttgtctgagagatagacctcatttaaaatttaaaattatgtgaaatcaagaaacgatttcccaagttgagatctctccactggcttccacaaggtcactcaataataaaacattttgaagtgggaaattgctcgtacaaaactaggcacattgccgccttcctacccacgtggaataaactcctgtctgcctagtagtttagctgacatttcatttactttcctaaagtttcagccacaattagtgatcaaagacatctggggtcctgtctccctagggtgtactcccagggaacattcattttagacagcaggtaaagaaaacaaggaagtcgttggcactggcctgatgtgcatttattttttatttacttggttttttgtttggttttgtttctgttttttgacagagcctcacggtgtcacccaggctacagtgtagtggtacaatcacagctcagtgacacctacatctcctgggctcaagcaatcctccacctcagcctcccgagtagctgggactacaagcatgcaccaccatgcctggctaattttttttcctcactaatttttgaaagatttttgtagaggtagggtcttgctatgttgcccaggttggtcactaacacctggcttcaggcgatcctcccacctctggctcccaaagcgctgagattacaggtgtgagccactgcacctggcctcccatgtacatttagtttctgatttttgtttttaggaatgattcaacatgatacacatattcataagaaatagcaaaataacctaaaatggaagttagcaagaagaaataagagggaatgaggacatcaagtggaatctgtaaagagtgtgataccaaactacactctactgagtcctcaacacccactgaatgtaggccacaaatttggatttcagcttcctaattcccaacaggaaaagaagaacttgatcaattcctacaatgcaagtattcacataagttaaaagcatgaaaggaacctggaagaacaattatccccaatacaaaatctaaaaataattttcttctgaagttaagaaatatcacgttctaacaatagaaggtactcaagcatcctcaccatggcaaggttgaggagtttcatagagctcttcttcatggcatgcctcacacaaggatagcatctcaccaaagcaaagtcagtatcatcaattctacagggtccaacaaattgcatgagcataaccagtcctctgtccacctggaccaaaccagtctttgtgcttacttatttaattaaatttatttatttatttatttttatttttgagacagagtcttgctctgtcacccaggttgtagagcagaggcacgatctctgctcactgcaacctctgtctcccgggttcaagcaatcctcctgcctcagcctcccgagtagctgagactacaggcatgcagcaccacactcggctaatttttgtatttttagtagagacagagtttcaccacgttggacaggctggtctcaaactcctggtctcaagtgatccacccgcctcaacctcccaaaatgctggtattataggcatgagccactgtgcccagccatcatgcttacttagaatactgagtataattcagtattattatactcacactcactcacactaagatctgtttcttttgttcttgcttttatcatctgctcacctcttcattgcagttgctttagatttggtcatctcggggtgaaagaagaaatagggctcaacctgtagctattggaacaggtctacatgaacccactgtcattttgcttggatgctctcctagattgaatgttcctggactgagagcctagtaaccagatagtggattcttgttatctactccagtaagtgaagtggtgcctccatccttggagtcatcctggacctctctcctcccaatttcaatccttcagcagatcctgtaggctccaccttgaaagtacttccccacatacctacaatctctgccttacttcctccagatttctgctcaagtgtacaaatacacatgacctttttaccttacttgtcggaaaataaacaccctcctcaaaccctagttccccttatctggctcaatttttctccctggttctccttactaaccacagtacttgaattggctcactgcgttttttgtctgtctcacgctagaagggagtttcatgtgggcatggtatgtgtctgtcttttcaccctatggtccagagtccataaaagctttcagcacacagtaggtattcaataaatatccagtgcatgagtgaagaaggagacagcatgacatggggttgcagaaaagaagccaatgactttgttttcatgttaaattgtattgagtagcaagcatgatgccacatttgagggattcagtagtgaccagaactgaaatggctatagccctccagccagctaaatcccttggcactgatcctaaaagacacaaaattcatggctgtgaatatcagcttgagcctcagatccttctctgtctttactctcaactccaagccatccagccccagggctagagctgacactgccttcgttaaacctgttcccctggttcttgaagccaaatttggtcttatgtctcccataggtctgtatcaggagggcagatgattctggcacaatacttcagtataaacaaaccacatgtgtaaccaaaaagcaaccaataaaattaagtacgaatgttccccagcaaagacaatctgtgctctgctccaaaggaatagaattccataaaagaaaaaaagaaagctgtggttttcttgaaggtctatctctattccattcacctgtacagatatttatctcagtaaccaaatatgtttttgacctactgctaaaaattcaccaccatgggaactaaaataaaacaaaagtctttttacaagcacagattttacaaacctcgattcttgctttcatctccgttttattcaccaagtgtagaagcagtacactttctaaagaatttaacataaagagcctttaacgtctccaagaagcaaagttcatgaagagcccaccctgtgattccctgtcccatgactacggctctcagtacggtgtgttgacatgatttctcatctgttcactgctctagaatagtctatcagctccttaaaatcaggggccgggtgtctcattcaaagtttggcaagctaagcccattgggaaatgaatccactctgacatttgcttttgtacagccccatggtgatatttaattttcaaatggttgaaaaaaaataatattttgtaacacctgataattatatgaaaatcaaacatcagtgtccaaacacgaagtttcaatgggatgtagccatgcccattcattgccagattatctatggctgctttcacgctatgtcagctacattagcagtccccaacctttttagcaccaggatctggttttgtggaatatattttttttttccatggactgggtgaggaggaggagaatggtttctggatgattcaagagcattacatttactgtgcactttatttctattattattacattgtaatatataatgaaataattataaaactcaccatgatgtagaatcagtgtgagccctgagcttgttttcctgaaactagacggtcccatctgggggtgatgggagacagtgacagatcatcaggcattagattctcataaggagcctgcaacctagatccctcacatgtgcagttcacaacagggtttgtttgcactcctatgagaacctaatgttgccactgatctgacaggaggcggagctcaggtggtgatgtgagccatggtgagtagctgtaaatacagaataagctttgcttgctcacccagcactcacctcctgctgtgtagcctggttcctaacaggccatggaccattaggggtccgaggccctaggattggggacacttgagacacatcaccacaatcatgctacatcgtcacactgagtggttgcaacagagacaactctgtcccaggaagcccaagacacttgtcatctggccctttagagaaataattttccagcccctggtctaatttatctcctcctccccacagtgcagcaaggacctagaacatagctgatgttcatcagtgtttattaaaatgaactgaaattgtcagcaaaactctgacctctggaaataatctgagatcccccaaattattattttgttatcttataaagcacttctaatacaattagcaaaggctctagcaattacaaagcaaactcatctctcatagaaagttccccagctaggaaaaactggagaaggtaattttatctgatggtatgtcattcagtccaagtccctcaaaacatcagtggagtaagcagaactgtggaattgtttctttgattccaggaatcctagaatcaatacccaacaccattatcacacacacgagcattaggccttgccaagggtagcagccagtaaatatcaggaatggagctaaggaatcagaaaattgaaagaggccccaatttttatgcctacaatatctgacccagccactacctgcacatctccacttcataagacatctttctgcattcccgcaaatgtgtcaaattgggagaaaatccttcctcatatcaaagcagggctaaacctgttgcctctctacctttgatccagcagtgatagttaaaagcacaggctgatgcattagaatgccttgttgtgaaatgtcctaggagcctggcaaattgtgtagcctttctctgcctcagttttcttgtcaataccatggggacaaaaacatacctgtgagtcttgcccaacaatatttaaggcacctacctttcatgatacgagtcagccataccctgtccatccagctgcttggaacctttactgccctcatcctttggggcagactttccattttcctttatgccctgagccactcattcatcctcgtctaagttgctaagcttttctactgaagttattgcaatcattgcaaatatcttcttacccatctccctgcctcctgagtctctacaaattggttcttcccatggaagccagtacctttctgcatggcatggatccctgttctgcaaagtccaggctctttggaacacagttctcaacgccatacatgacttgaaaagctcaactcccgatgtgaggctcttggcgttcaccctcagatgaccatatgttcccccaatgagccagtacctcaggttccccagacacatgctgagggagtctgtgcagtaagaaatctgatctcactcaaagagagatctgttgtccctacccctgggaggcaatctctaaacttgggatgtcctgagtggtaggtgtctttgttattcatggtgcccctaggaccatgcctgttagtttttgctagttaggaggcacctggtagagcccctccaggccaattggtatgagcccaatctccagagaagtgggaagggggcaggcagagattgattttaaccacacgggtcatggctcgatcaatcatgcctacggcatgaagcctcagtaaaaactctggacacttgagctcaggtgacttcccacgtgggtgatatttcgtgcatcctaccatgtgtggaaatgcatcctgaaaacaatggaagcttcgcattgggaattcccctagactctaccctgtgaactcctcttttggctggttcagattcagatcatatccctgtaatagacgtgagccttagcataatagcctgcagtgaatcctgggggtatttttagcaaattgtgaaacctgagggtggttttgagaaatgctgaacttgtggttgggcagacatcttgaacatacttggcaatttggaggactgtgcttgcttttttttttttttttttttttacggagtcttgctctgtcgcccaggctggagtgcagtggcacgataccagctcactgcaacctctgcctcccgggttcaagcgactctcctgcctcagcctcctgagtagctgggattacaggcacgtgccaccacgccaaacagatttttgtatttttagtagagatggggttttaccatgttggtcaggctggtcttgatctcctgaccttgtgatccgcctgcctcagcctcccaaagtgctgggattacaggcatgagccaccgcacccagccaggactatgctcttaacctcagaggttggcacagtctggttttacatgatcctaagatggagaataaggaagaaggggagtgaggcaggggacagaagggagtccagggtacactaaggtaatgctttatgctctgagtacctgggggtcacctgcactgggaaccactgggagtctgttctccttctcaagtgacagggaagccatggtatttctcatctactacctcctgtctattggcacttgagggcagttcccgagggcattaactcccagtacctctagcctgcttctcagtcagaatagggaagtttccacactatgagcaagttctcagatagagagtggcagatgcagcagaaagagctgtgggtgctcaatgtattggcaagcaccatggaagggacatggttaatgccctactgcatgagctcagctatttctaatgcctcagatatgccctggtgcctcttgctttcttgtaacatgctgtccaacctccctgttggacacggccaaacccctccacctcccacgcttccaattagctagctcttcctcagaggtcagctttaatttgtcccagggttatgggtccttctcctattttccctgccagttcacttatagcattttcaagctgttaaaatttcctctttattgcttgttttccctcctaagactatgtactgcttaaaggttggactcatctgttttttaacctccatgccaaagatacttacgaattgttcaatgaatatctatctgttggatggatgaattcattctgggactgaatgtatgaatgaatttaatacttgctctcaggagcagtctcaccttagagggggtcacaaaaattcgaatggaataattgtagccatggaacaacctccttgatgaagatatgctggaaaatatcttcacaagccctcagattacaccacctagattagaggactacctcttctgctctcactttgcaggtaaagaggcatgcaccagaatgctgtggaaacatgatcaagagtggatggcaggctgggcacagtggctcacacctgtaatcccagcactttgggaggctgaagtgggaggattgcttgaggccaggagtttgtgaccagcttgggcaacatagaaagactttgtctctacagaaataaaaaattagcagggaggccaggcacggtggctcacgtctgtaatcccagccctttgggaggccgaggcgggcggatcacgtcaggagtttgagaccagtctggccaacatagtgaaacactgtctctactaaaaatacacaaaaaattatccgggtgtggtggtgtgtgcctgtaatcccagctactcaggaggatgaggcaggagaatcgcgtgaacccgggaggcggaggttgcagtgagccaagatcgtgccattgcactccagcctgggcaagagaatgagactctgtctcaataaaaaaaaaaaaaatacacatctatgtatatattagtagggtgtggtgatgtgtgcctgtagtctcagctactctggaggctaagtcaggaggattgaatgtgaccaggaagtagaagctacagtgagctataattgtgccactgcactccagcctgagcgacagagtgagactctttctctctctctctctttctttttctttctttcttccttcctttcctccctccctccctccttccttgcttgctctcttccttccttccttctctccctccctgcttgcttgcttttctttctttctttctctttccttccttccttccttccttccttcctccctgcttgcttgcttgccttccttccttccttccttccttccttccttccttccttccttccttctttcttttctcttttttcagggtctcactctgtcacccaggctggagtacagtggtgcaatcttggctcactgcaacctccacctcccaggctcaagtgattttcctgcctcagcctcccgagtagctgggactacaagtgtgcgtcaccacacccagctgatttttgtacttttagtagagatgggattttgccatgttggccaggctggtttcaaactcctggcctcaagtgatccacccacctcagtctcccaaagtgctgggattataggcatgagccactgcgcccagcttgtttttagagaaaaacaaaaacaaaaagcaaaaaagagagtagatggcaggttggaggagggacactttcacactttggccaagttctcaggcagatgtaggcagaaatgcactagaacatcatggaaaacatgaacaagagcagacatcagcttgacacccactgaacacaggggagccagcatagaggagaaggggctaccttcctgcatataacatgaaacccatccctgataatgacttccgaggcagctctctgggcaacgctgtcttgttccatacacacaaaaacttgtttcttgttccacacacacaaaaaggtctcaggtggacatgtggacattgtctttgggagactggcttaggtttgtttgtgttctccccattcctctgccttctcctgactaggcatcagactcaagtttggcccttgcacatacttctccctgatgagttattaatactaacctttgcttgcaccatgaactttaatgacatgcccaaggtcagccagcttgccagactggctctaaaacccacctcattttatgaccaagagatatggccagggacgggggctcatatctgtcatcccagccctctaggaggccaaggtgggaggattgcttgagcccaggagttcgagaccagcctgggcaacatagtgagaccctgtctataattttaaaaagaaaatttttaaaaaagagaaatgcatatagactttaacccaaaactatgatataatcttgttgagaatacaaactctgcttcatgcttcctatgcatacatgccctaaagaatgtatagagtatcctgtaagtagcatgtctttgatatatatttatcataataaataaaactttaatggcccagagagtgctacaagccggggcaggcctagaagctgaacagcaaacaggaggacaagagaaccacagcagtgcaaagtagaagacatttttaagtaacacactacacattacagcagtacacagagcagccaggtgagaaattatgaggatctaggtggatgggtcagttttctagaaatgccacaataaagtcccatagactgggcagcctaaacaacagactatttattttcccacacccctggaggctggaagttgaaaatcaaggtgtgggcagggctggttcctccagaagcctctctccttggcttgtagatgctgtcttctccctgtgtcctcatgtggtcgaccctctgtgtgtgtctatgtcctcatctcctcttcttatgagatgtcttattcatttcaggctgctatcacagaataccatagaccgggcagtttataaacaacagacatttactctcccacagtcctgaaggctgaaagtccaagatcaaggtgtgggcagggttggtgcctcctgaggcccctctcctgggcttgtagatgttgtcttctccctgtgtcctcaccaggtcatccctctgtacatgtctgtgtcctcatcttcttacaaggacaaccggtcctataggatcagggccctccctaatgacctcattttaccttaattacccctttaaagaccctaactccaaatacagtcacattctgagcaactgggggttaggacttcaacatctgaatttgcagggaagacagaatacagcccgtaacagtagactttttggaatgctactgcctgtttgattttaatgcaggattatatttgactacaagtccaaacactatagctagcctagaagggttgcagccataacaaaggtaataaagaaccaccttccccatgacccccatgtggtccttgccccctgatggtcctgggcaagcacagttgatcacaatcccaattagcactgttacttctaggagcttaaaaacaacagcatcgcgtttcaactagcccttctgccagagtgcatgtgctacaataacatactgtaagggacggacatcaaacaggagcacatcctctcggggaaactgcaagaaagagggtttaaaacactccaatgaaatggagcaagctgcaatgaccattaaggacacgctgagcacagaaaactcaacaaagatgaaagaagaaagaggaactaaaccaacactagtccttggtaaattacatgaacctcgtttcttggtatcttttgattacactcaggcctgaggcatctgtagtcctgcatcaggctgatgcccctgaagcccaagatctcactcccagctctgctcttaatgcaggacccacaatttttgctttcttctgtaaatgaccagatagtggatattttaggcagggatggcttcaagggtgagcaaattacagtcacgcagggccccacatttagaaggggcccaaccttggtttaatgctttgccatcactgtcttcagattcttaatttttcaaaggggccttgcattctcatttttcaccgggttctgcgtataacaccacaggtcctggttttcatcttcgcgggccatgcagtttccactgaaattatttgactctgccggtgtagtgcaaaatcagctacagaccataagaaaatgaataagtgtggctgtgctccaataacatttcatgtgggatgctgtcatagattggactgtgttccccccaaaattgatatgttgggcccccagtaccctggaatgtgaccttatttagaaatagagtctttgcaaatgtaattgcttaagatgaggtgtttagggtgggccctcacccaatgactggtctccttataacaaggaaaaatttgtacatagacagagatacacatagagggaaaaagatgtggagaaggccaggtgccgtggctcacgcctgtaatcccagcactttgggaggccgaggcaggcggatcatctgaggtcaggagttcgagatcagtctggccaacatggtgaaaccccgtctctactaaaaaaatacaaaaattagccaggcatggtggcaggcacctgtaatttcagctcctcaggagggtgaggcaggagaatcgcttgaacccgggaggcggaggttgcgatgagccaagatcgtgctagcctgggcaaaaagagtgaaactctgtctcaaaataaataaataaataaaataaaataaaataaaataaagatgtggagacataggaagaacatctacaagccaaggagagaagcctggaactcatccctccctcatagccctctcagaaggaaccaaccccactgacaccttggttcacacttccagtctccaaaattgtgagacaataaatttctgttgtttaagcaaagctgtttgtgatactttatcacagcagcctgagcaaactgataagagatacggaaatttaaattgcatataattttcatgtgtcaaaaaacattctgtttctttggatttttttttcatcatttaaaaatgcaaaacccattcttagctcatgagccatacaaaaataggtagcagggcagatttgggctgcaggcagtagtttgctgactcctattgaaactgtgccccgaggagttaaagaaaccaatgactaacagaaattcttgagtttgcaggatggtagataagaaaagaaacaacctgctgaaatgctgaaactccctatgcttgtaagataacaaaactggctgaaatcagttggaaccaatagatccaactggagcctgcccagaacaaagcttgctgacatcatggcctgaatttctatcttgtgtttcctactaactccctctgaatgtgatccatgaagtactgtgaagaggtaactatgcctgcccaaggactttccataccttccctttccttccaccaatcaaccactaatcccaggatccaccttttctaataaaattattacattacatggaatcaatccaatgcccatcaatgataaactggataaagaaaatgtagtacatatgcaccatagaatactatgtagccataaaaagagatcatgtcctttgcagggacgtgggtggagctgggagcctcagcaaactaacacaggagcagaaaaccaaaccctgcatgttctcacttataagtgagagctgaacaatgagaacacatggacacagggaggggaacacacactggggcctgtcaaaggggtgggggaagggagaacatcaggataaatagctaatgcataggtgatgggttgataggtgcgacaaaccatcatggcacatgtttacctacgtaacaaatctgcacgtcctgcacatgtatcccagaacataaaataaactttgtttgtttgttttctgagatggagtctcactctgtcgcccaggccggagtgcagtggcgcgatcttggctcactgcaagctctgcctcccgggttcacgccattctcctgcctcagcctcccgagtagctgggactacaggagtgcgccaccacgcccggctaatttttttgtatttttttagtagagacggggtttcaccatgttagccaggatggtctcaatctcctgacctcgtgatccgcccaccttggcctcccaaagtgctgggattacaggtgtgagccaccgcccccggccagggatttttttttttaatatggtactttgtagcctctggaacagcaatacagaaattccagccactacaaaataaatgtatgcgtgcatgcacacacacacatacacacacacccctttaccctttcagttgagccttttccataaacaaattcaccctcccttgatgaacttgatttgcaaggctaaaaccaaataaggtgtaagttaagaggagagcctgctgacacaagggtaccccacggtctctgcagataggtttctcctcctggtaaaatctcaacaggcacagagggcaagaaagaagagcagccacggtggtgtctctgcctccatcacaggctcttctgcattctttctctagcaccatttctctttttgaagaactcagtgattatggcttttggggcacaatttcacaggtccgcataagcagatgtttttatgcatatcgtctcccccagggctctcttgtgaacactgtataagcaggcacacaaaatgatgaacaaagcgtccccaggacccctctgagatagagttgatctcaggcatgagcaagagaacgacaagacaagcctgaagcatcccgtcatgctgcaaaggcgggacgtgctcccagaatgacaggcactcatccaacggacgcagcagtgtgcttcaaaattccccacaagtcaaaccttgacaaactggatatcaaaacaaataatggtgggaatggattccaacccatttcaatacttcagaacccatgagtccatagtgacaacacacaaataagaagataaagctctgccttaaaacagaaagtaaattactaactgcataaagaaagaagtgcctggcagtgcccaggctgatctgtcacagagttgtacttcagaggtgagatattgcactccctaactcaatcactagtcaaaaggtcttgttaatacaaaagacttttctaatcttggaaaaaaatagtggaaggtaatactgtccaatgctaatagctaggtggtagatatatgggtaacattttttccctccaactatttccattctttacgtattttgaatgggtgtgtactgcttttctcatgctcataaagacaattgttgaactctaaaacatcaaaatatttcattattaagactactcagtatggatgtaaatattgcaggtgctgagatgttggggacccaattcacttaaacattttttaaattctccttttatataagttactagtattggaaaataaaacaatcagttaagttgaccttcaataacttaagagataatggtggcaatatccaccatgattattttagcaaagcaaattactttggatgatattctttaacatttaaaacgttggcatttctttactccaagtcctccatgccccattttttaaaaagaaagggaagagaaagaccagacttggtggccaacacctatgatgcttgagctttgggaggctgaggcaggaggattgcttgaccccaggggttcaagaccagcctgggagacatagcaagatcttgtctcttcaaagaaaaaaaaaattaattagctggacatggtggtatgcacctgtagtcccaaggctgaggcaggaggatcgcttgaggccaggagttcaaggctgcagtgagctacaatcacgccactggactctagcccaggtgacagagcaacaacctgtctctaaaaacaaatatgatactaataaaagaaaagaaaaaaatcccaaattttaaccttattatataatctttgatgtatatttaccagtatgaagagtcccctttgttgtatttaacaaattctaaagaataacacggttatagggaaaataaaggaaatagaaagaggttaagaatgtttacattttcactattatcaattcaacaactccccaaccagtattagattattttccctatatcataaatgtcataataaaaaatgaaataaggttcctggagcctgagagaaaataaatacatatacacacacaatggagtcataaaatctgcaacattgtaagttttcccgttgtaactttcaatgtgttgaagcatcttcttagttggttacaatgaacactgaaaaagctaaattgatatatccccaaagtcatgaaatggtatctcagacacagggatgaccttcagaggaaaaatgctccacattccccacatgcccaagaagcaaaaatggacagactgtttttgtactaaatgaaactgtggcgtccatccaaaatgtggacattgacatcggcgctgataagtccccttcaactttgcatttcctcctcgtctccaggcttcttcataactggaaattttgactctcacacaactcacttcaccttgtatgccccaggatgaggttgaggggggcccagacaacatcaccccatgaggggaaactgccccaaacaaatacaccaagtatcagcagtaggaatagccagggagaaaatataccctgctctaggctaatttgactatgaaaaagtttcatttttaggccagccattacccatggcttgggctgaatagtatagaactccataggtgttagaaattataaactctgtcctcctgatgctttcacccaaggctgtcccatcaggtgctcagagctgctgaaatttctccttaaaattctagcaccacaacattcaagtctaaaaagtggaggaattgagtttacattggtttgactggatattcaagccttcccgtactggacaaatgaaactcttctctaatttccataaagcttttgtttgtttgtttgtttgttttttgcggggggatgggggtggggagttggttgttttcttgagacagagccttgctatgttggccagcatggactcaaactcctgggcttaagcaaccctcctgcttcagcctccagagtacccggaattaaaggtgtgcaccactgtgcgagcttcattcaagttttagaacttcatccttaattttagacaaaaacagaggaaaccatctcatcaaatcactccacattttaaatagaaaagcagagttccagagaatgaaaaccactgtgggccggggcttgcacagtgggcaagagacgaagtgttgactgtaatgtgggtcacacaccctttgttcatttcagaccctgtgaggtctactggagataaaatatcatcagccgtatgggggttgcttcttagaaggagtaaggtaaggtagagtaaggtaagggatttagtggcccaataccagaaaggagtagtgtgtttttagaagacattctcccaaatcctgcctggccgagaagggtaagagtatggctgtggaggattaggagagtgggggagctgagagcatgaattgtagagccagatggactggattagaatcttgtcactcttgccttccccatatgcataatgagaaaagaggaataactattttgtagaagtgcaatgaggtctgagtgactgcaaaatgctgacgagtgtcaagtgtcaggcgtatttaaggtatttttaaattttttttttatttccataggttattggggaacaggtggtatttggttacatgagtaagttctttagtggtgatttgtgagattttggtgcacccatcacccgagcagtatacactgaacccaatttgtagccttttatccctcacccccttctcaccctttccccgaatccacaaagtccattatgtcattattatgcttttgcatcctcatagcttagctcccacttaggagtgagaatatatgatgtttagttttccattcctgagttacttcacttagaataatagtttctaatctcatccaggttgctgcaaatgccattaattcattcctttttatggctgaatagtattccatcatatatatatatatatatatatatatatatatatatacacacacatacatatatatatatggtattccatcatatacatatatgatagtccatatatatatatggtattccatcatatatatatgatagtccatatatatatatatatatgatggaataccatatatatatatgatggaatactatattatatataccatatatatatcacaatttctttatccactcattgactgatgatcatttgggttgattccacatttttacaattgtgaattgaggcacacataaggtctactaagttaaaacaatagcaatgaaaacctccacgtctatagtaccagaattgggattatcaacaaaggtgcagggtgccagcttccagaataccactgacccaagagaggcaaatcaacctgtgggagccattaaccttccactgttctagccacaaacacatcgtttgactgatcgactttgagtcaaaaggtttgggatgagaaaggggagtcacagtatcaaaacgatcaagtctccagagcctggtaggagttctgagtcactctcctttttaacttcctccttgcttatctgcagctgctctctgccgcctgacggccttttgcccaggaggtcagagaaggcaaagctgtctctcagtaattggagatgtctggctctgtgtgtgggaagttgaagggacacttggtggtgccttcctccctcaaagcgtcacagcaagtcctttcattgtggctaagcggaaatagccaaaagagaaagggaaaatatcgtctcttatgaagacaacaagaagaccaggggtgtggaatgggagaaggatgaccaggcacagcacagggtatttctaggactaggaaatcatggtataagataatgtaaaggtggatgcatgactttatgcatttgtcaaacaccacagcatatacaacagcaagagtaaaccccaatgtaaactatggattatagttaatagtaatgtatcgatagtaatccatcagttgtaacaaatgtatcacactaatgcaagataacagtaggggaaataccagggaggaggaagggagggcatgggaactcttcattttccactccaaatcatcatatggctgatgatattcagcatccaatagacctcacagggtctgaaatggaatgccttatcaggcccaaaactgctaaaaaaaaaaatagcctattattttctaaatctcagattgcttaatattcttatatacatgattaataatgtgtactattatgtatgtacatcataatataggtaatctcatgcataatatttaactaacgatgatacctgtaagaatttatcacttaattacaaaggctgtgttgagattaacagtccttcaaagaaggtggatgggttgagatgatgtggtagatcagaaagaaagcacaatttagaatcctatatagaagttttctgaaaaacagacacacagaaccgattgctttaattatcttaccatcatttggatagggtaaacacaccagtttgcatatactcttaagtaactttcatccaagtacagctgacatgaaggtagcttgcccaatagataaacgatgagagaaaagtagagaaaacatttactatcttttttattcataaattctaaccctcccccacaaaatgtgttggaactatgtgattaattctattaaaagtatgctcgttctgtctgtaaatctgtggagtaaaaaaaaaaaaaattcaggagtggttccccatcatcagaatctgggctcatcatttccttctttccctgagtttataaagtatctatcagcatagtgcctaagatgtaccagaacatttacagaaatcatgatttccttttgtttttgaagcctcatggacctgcaaggtaaagttttatttttctaatcattattttggagaagaaaagggcagggagataatggtgatggatgcagccgagagttgggattggaattggcgttggctcattcctcagcctctgattccaattggctgtaccacctaacatccatcatgtcgccttctcaccgaggccaacatttcagaaaatgccagtcctcatctctccaaccacgcttgtttaattaccattgagggaagcaactacaaatactcctagggccaaaccctggaagaatcccagcaacacacagaaatattgaacttacccaagaattttcctagatggccataaataccatgaaattctggacaactcaaatttacatctctagtcctgactgtttctgggccagagacttcagatgtccacctgcctgtttagtagctccccttgatataatctcacaggcttaaacttattatgcccaaaatgaattttaacagggcttccctttttcacacaaggaaaagcccggctgctcctcttccagtcgccttcacctaagtaactggcctttctccccactttcctaagaaactggcatcagaacggatgtttccatctccctcgcttcttgtatccaaccctggccaattttgcctcccatctcccgaaatccatccgcctcaccctgccttcactgcagcctcacctgagtgagctacccacctcttctgtctaaattagtgtgtttgttttggaaccagactcccgctttccattctcagccttcttcatcattccccaaaatatcttgtgtcaaatcattcccctccttacagcctctctggcttccatcactgcactttatacagaatataaaagacttgatcctctaaggccctgtcgccaggtgtcctgtcatgatacagcagcttcttaaacttctctataggtaccaaataattttccacctcagtgccattgtacgtgctcttctctttaactagaaaacccgactcttcagaagttcatatcctcagagaacttttgcaataattcatatctcctatctttcttagcatagtaccctattttctcaaaatcatgtaataccatgtgtattaactgagcaaacactgacttccttactttcttaagaccttctgtgtttagtgtactaattctgctccatgaaggcacggtctatatctgtatgagtagtaccttgcaatcttttgtcaaataaaacaacatctatacataatttacatgataatgctgcatattatgtgtatgagtatatatatatatatatggtcttgtatacattatatatatactatatatatagtatatgctgtatagtatatatatgtaccatatacatagtatacaatagtatagtatatatataagaccagtatacaagtatacaagaccataagtgaaaaaattccaacgacaggaattaatttgctttcttttttaactttcaaaaaaattattatttaattggcaaataaaaactatatataattattgtgcagaacatgctttaaaatatgtacacattgtggaatagttaaggtagttaacgtatgcattacttcacatattaatttttttgtggtgagaacactcaagatctactctttcagtgattttccggaatacaatacattattaactatagccaccatgttgtacaatagatttcttgaccttactcctcctaactgaaattttgtatcatttgaccaacatgtccccaaactacctccttcccaattttcttaaatttcattaaaaaatctcttcctggaagaaatcacagtagtagactgatgactggctttacatatacacacatgcacatacacacacacacacacacacacacagacacaaacacaccccagtcatgtttacaccacaccactcctctgaggtcagattgagttaacactggagcccactctgcatgcaatgggagcttgcaaacccacctttatggcagggagcatcaggccttcagtggcccctgcatgtgaactgcctccatggtctgatgctgaggacaccctgctggtaatgcagagaactgtgcatagaaatccctaatctgcctgtccagttccccctgaattggcttgaagcagtgggaagtcgaaccacacaagagagtttccttgtcaagtgaccggaggtcagtgttattatctctgtcagtggccaggggtgcactggttcccagcatatgagtctttcattgctaacaagctccactgcatttgagagagcccctgggataggagagcagggaggcttatctcctgtctcctggatgaggtactgagaaagagacaccctccgcactctgctcctcactgaccaatgaagggactcacgaatctgttaatttatcaactagggtgttcgacctgaacactagtgatatcctgattgtaacaggaaatctcatcaattagaggatgtctgatctaacagggcaggagaccataactgttacttgtattgtttcagggagcaaaaaacaagagtgaaagaaagcattaacaattaagaaagcattttcttaatttctccagagaaaataaaacccaggaaaataacaaaagcaataaggaaattaaaactttatccaaggagcatataactaaataaatgccatctaatattgggcatcatcaatgtactttcaactttatgtccgcacatcatagtataaaagagaactgtaaaaaaagacaactaagttttacattgaaatcatttgttatatcagatgtttttaaatataaacatatgaaggtgatataacaggatattaagatgaaacctgtattttaacattgttaatgtgtcaccataaatttaccttttggcattattttggtaaacagcactgaatgttccatgcacggcaaacaactaatttaatgtagcttttaaattggcaggccatactaaaatttagctattttctttgcttactgatgtcatctagaatgacgcttttgttgttcttttccacagacttacaagcaattttatgcaacatgacgctgcttccaaagcatccagaactatggaacttggcaggtttaccagtgtctgctcgccccaactacaacctttatggaaaaggaaggactcagtcagacagaactggagagtttttccaaatgccctcaaaaaaatgtaccctggcttgaacaagagagccagaacagcctggtgggacgtcagccttctagatttagcatgacatgggcagcagtgcagttctgaagaactcccctgcagcacacacagctcctgatttctatctgtgctcactggtctggattttgagagttttgagaaatgaattgtgcatcctgttatgcctcgaaacgttaactcaactcatatttttaagtggtcacgttaggtaagtatcccctcattagaacagagacaatgcttgattcattttccaggttgagttgtagttaacatgtgagtgggatcgaaccaccataggtacagatgcttagagaacaggaacaacagagaagggacagagacagtgaaggaggctgtattgtcttcacacctttacaggcagggcgacttcagcaagaagtaatttaccacccacactaagctctttatcccagatttgctttactgtctctctctacccaaggtgtcaaacactcactctgtcatcatgttgcaaatggcactagtaaaggaaacttccccagctcccaagaagggccttataaaccaagtgtaacaaccttttggcttctttctttacaatgagaaactcattagctggattattttttttctttttgacatagaaataatctgggactcctttcacttttatgtgatagaaagataagacgcagaatcaacatacaaatctgctataaagagtgcagaaagcacttcctcaaagtctcaactaacttttccccaaaaaactatgcttgataaattcatgttttttagaaatgggtaaaaaaatgcctacttagtctgttttgctgtttatgttagcgattctgtgatccagtgacgtcagacttataaaatcaacaagtttcacaaacagaataagaatcactccttaaaataacaaatgttacccgttgagtgatgtgattgctttatcgtctctttaaggcagggatgtccaatcttttggctttcccgggccacactggaagaagaagaattgtctttggccacacataaaatagactaacactaatcatagctgatgagcttaaaaaaaattgcaaaaaaactcacaatgttttaagaaagtttacaaatttgtgttgggccgcattcaaagccgtcctgggcctcatgcggcccaagggccatgggttggacacgcttgctttaagatcttagggaaacagaaggttaaaatgataagcatggaactgaagacttcataagaaaatgcacatgtcccattcatgtgaaattcgtaattcacacatgtaacttcctgactcacccctaaaatgtgggggaccccaggaaccacagagaagctccaaatggattttctcaagcaaactgtaatatataaatatatattttacctcctaaccaggtcttctctgccctgccttctgccctgtcttctttccacacaatcaacctcatgtaatgtaacagcaaatcctcatttccacagcccacttttggtggaagagtcatttttcccaaatatgatcgaaaatgcattatgtgagccagtgaaggaaatccagaaatagggtctagttcgtctgggctcctgtacatcctatacaagaaatgaactttgcaaaatcccaaagctgtgaatttggcacctctcaactagcacaaatttcctttcaaacattaggaagagaaagagaaaaagagactccaaagtattttgtaacataatgtattccacatttccataggcatcatttttaggccaaaacatatggtaatacataaactgatcatatgctgcctgccacgctcagcagagaaaggcagcatctcaaaggatttcctcaaatcctttactctaagaaaggcatggaaaccatttcatcagaaatcattccctccgtggcagtgtgcaaagacagtccacccagatgcataataaagcctcaggaaataatgacaacagcagcctctattgcaagtggagctgaaaaaagcggtgggtcttaaccactgatacaatgcaatcattaagatatttaaatataagaagaccatttcatgcgtctctaaagcttaatgctactatctcaacaatccagtgtagaaattgttaagaggggtctctctctgggtgccttaatttatatttcttttttttttttagtttttatttttattctaagttccagggtacatgtgcaggatgtgcaggtttgttacataggtaaatgtgtaccatggtgatttgctgaacgtatcgacccatcacctaggtattaagcccagcatgcattagctatttgtttggatgctctccctccccccaccccaccccccgacaggccccagtgtgtgttattcccttccctgtgtccatgtgttctcatcgttcagctcccacttatgactgagaatatgaggtgtttggttttctgttcctgcattagtttactgaggataatggcttccagctccattcatgtccctgcaaaggacatgattttttcatttttatggctgcatagtattctatgatatacatgtacattttctttatccggtgtatcatatattttttacttctgtaagcaaaatgtcattttgactgtttctcttttatctaacccaaatggccaactagccacctttatttgtagggccagcaaaaaactaaattttagtattgggttcctatatgtctcatttaatattatatactttgattttctctccaaattacctcatttggccaagataacataactaatgtgcaactacttaagcacatccctgagttttctttttaaagtggaagctaaaggaaaactaagacacatgcattatgttatctttatttgtataagctaatcagagtaaaatggtcttcccaaatatgaaaaataaaatgacttgatacatgtcaaaaaagggcacatcatctgtcaataagtcctgttgaagtgtgaggggaagggagtgaagttctgcttttctttaatgagatgtccccataaaaatatgatttgtgaatttgtaaggatccctaactgtcacataaagacctggactccacccatgtaacacggtcatggtctagccagttttcttttttaaatatattcattttttattgcaagggttcatcctacacattgttataacagacaaataaatcacttcacttttctcacctgtaataaacagagagcttctctgttttacagtgttacaaaattaaatgagacaatttatgacaaaccatttgtcgatcatggagtactccacaaacagctgagtactgttgctaataatatgacttcagtgacaatcataacctcagaaacttaagacagagcctgtctatggcaaagaaatctagaatctgtggtgtctcattcaaagaaatgtattttcatgagaatatcacttccctgctcccagtcctccttaacttttccctctcgcctgagaccacactgcctgatagaaccaaatgtcagcagtgacagtggggaatactctaagttggtgctgtccaatattgcagtttctagctacctaggacactcagcacgtgaaatgtgactagtgcagtttctcactctcgccactgttgacatattgggccgatggttccttgcgatggtggctgttctgtgcatggtaacactaccacgcagcgtgttgagctgcatccctgaccgcccccactagataccagtagcacctcttccctggtagtgacaactaaaaatgtctctcgacattgccagatatccccttgaggacaaaatcacctctggttgaaaaccactaggctacagagatggagaattttcattgtattcaatttaagtaaatgtaaacttaaatagtaaatgtggctgatgtctaccatactgaacggaattgctttaaaatttactgagattcaaaagataaatgttggacggatggatacccccttcttcatgatgtatttatttcacattgcatgactgtatcagaacatctcatgtaccccataaatatatacacctactatgtacccacacaaagttaaggaaattaaaatttaaaaagaaaatttactgagattatttttcgaaaacagatacaacagttaagaaatatgttggaaagtttagattacatacatatatatatatttttttcctctgaaagggctaagcatatgttaaacaatgtaagctttcattttatttacacataattatttatgtgctgcctttaactcagagcagtaagagagctcataacctagcaaggcataaaaaggtacaaaagtaataataaaatggaggagggggaaactaccacagtggttttatatccattcctgccacccagggagggaataatgagatgaacagatatcgatgggttgtagggtccagaactaaattaaaaaattaacagccataaccaccccaagctgttcctgctgggctcgccatgcttgccccacccaggcaaggtctggattgttcacaagcagcaggaatgacctgacccgcaagctctccacagacctgcgctgatggtttctcacttccctcattagacactgagccaaggcaaagaaacttttaaaaaagtgtttgcaagggttcatcctacacattgaacagtttagtaactatcactttcatttgaggagtgaaaacaatttcctatcataatgggacaactgtgttaggttagggaatcctatacgttacttaaagtcccaaagtgaatccaagttcaaagggaatattgtgtaaaacaaacaatatccctgagaatttcaaaggagattgaaccccaagtgcctagagattccaatgtcttcatttctggttctacatgtagggagatgatctgaaagaagcaatattcagtatgatgaaaaaattaaattttatatttcctttccaaatacttggagagagaatctactcagtttctgatgccaagaacagaaatttaaagtatgaagaaagaacatgggctttaaaaacaaaaagtcctgcaatgtagtccccaaatgacaaattttgggaaccttgtccattattccttctgaccctcagttgtctacattgtacaatgaggaaaatgacagctacttccttgggttattgggagaacttgaaagggcccctagaccaacctgtgtatgtcgcccatttcacattctctaaacttcaattccctttactgagcatggccaatcttagtgctcaaaggcacagaaaagaataaaagcttgctctgccttttaaggagttcacgtgagccccaacagttgtaatccacagcctcttttcccaaggagatgccaaacgatctggggagacagacacataaacaagttacccaaacactggagcagatgaaagaagtccatcatggaaacacacaccacttactgtgagagcacccaaactccacggctcatataatctacagagaaaatgttcccctaagtgaacaaccacccaaagagagcaaagtaaacaactttaattacaaaacagaaactgtcaggcatctgttaggttcaaggggcctttccaatggataaacagttataaaatcatgggttcatatatgtagttatccaactcaagagaccaagagactgaggatgataccatcctgccaaccttcagttcaacaactcagagtgaaaataataataataaaattaaaaatcggctttaagaggtaaagcatgctaagagaaataaggcagacacaacaggataaatatcctatgattccatttgtatgaggttctcagagtactcgaattcatagagaaggaaattagaatgatggttgtggaatggggggaatcaattaataattacattgattttctttacaagagtccctataagtaggcatattgagatccttaggcctctagagacacagagtcaaatgtttcacacttttaaattatttatgcttataatatccacctttagggatttcttgcaaaaaaaaaaaaaagtcttatcctgcaaaaaggttatttctacagtcaaattcataaaaaccgaaagtagactggtggttgccgggggctgagggagggggaaatgagaagttgttatttcatgagtatggagttttagtttggtaagatgaaaaagttccggagatctgttgcacaacaatgtgaatatacttaacactacttaactatacactcaaaaatagctctcacgctgggcgcggtggctcaccagttgcatttccaacaacgtctcaggtgatctgaggctgcagggtccataaaccacactttgagtagcaagagtctaaccaactaaattgtgaatactgaagctcagtaatcccagcactttgggaggcccaggtgagtggatcacttgaggtcaggagtttgagaccagcctggccaatgtggtgaaaccccatctctactaaaaatacaaaaattagcctggcatggtggtgtgtgcctgtaatcccaactactcgggaggctgaggcaggagaaagaattgcttgaacccaggaggcagaggttgcagtgagccaagatcgcaccactgcactccagcctgggtgacagaatgagactccatcaaaaaaaaaaaaaaaaaaaaaaaggctttcatggtaaatttttaatttttaaattatttatttatttattcttagagacagggtctcactctgtcacccaggctgggctgcaatgatgtgatcatagctctcagtggtaaattttatgttttgtgtgtgtgtgtatggtgtgatttttttaccacaataaaaaataaaaatgttacttttataataaaagaaaagctgtttattagaaagaagtaatagtcataaaacactaactttcttcaacatatttcaatgatatttcttcaaattaaatttccaaacagacaactgtaataaaaattttgaaccagggtgtttttgttggtgaggaaaagttttagagttgtcgatcagatgatatcccaggaagacataaggcaatctaatcaactgtgcttatttctcctattttatacaacttaagtgacatggaggcacctgctcatttcaccttccacactgagaacactgctctcagctcatgtccagtaatctccttcttcccgtcattctctcactctagcactgagcactaatcaactctcataatatgtgatcaggttatgtatggtacagattccctagttaagagtatcagaatatgccatcccaaaatatgctactttggcataaggattattttgagctgagagcaattgagaagcagtagatgcaggaagaactctctgccttccccatttctgcttaaaagcagacataaatttcccctttgtaaaggcaatgtaagtttccatttgtaaaaaggttcccttcttccataccaggaagagaaaaataactcatattatccgcataacaagccttagtaaacaagccttatctaccatacatttctaggtcactttcccacaatttactgcccggagcccaaaacccccttttctttgtctattctcctctccacaatgtattgcccttcattaaaatggtatataaacttctaggtctaaccacttctttgagtttttatttcttttctgtgaagtccctgtgcatgtgaaattattatcatcaaataagctttgtttgccttgttttcctgttaatgtcttttgtgcattaaatttataggccccaataacagaaccctgcaagggtaaaaggaaagcttttccattgctatactagtgtatttacctagatattttatatatgacaaagaaaactagtatcaatacaaaccagtaaaatgtgaagatgaatatttacgtgctttcaagagaatatagttacatctcgtttgagagattgcccagcctctcaaaacctgacttccctcttttttctcttcctcatggccacactaccaaaagaaaggagaaccatacccggaatgaaatttctccctttccacactttcctcaagtaacatgcagtctgccccctgtcttccaggctttcctaagactcctctttcaaagtctccaaggacatcaaggcccattctatggtccccacatcttattagccacaggactttgagagggtcactctgtccagcattttgcataataatcaaggaaagtgaatactttccattcccatctcagaaagatgctttaaaagcaaatggtattcatttatgtgacaattctttgcaaactgtaaatcctaaccaaatgtaagatattaagataatgaccaaagatcaagccaaagttactatcaacatatttggggagaaatccagaagtaataaaaatgtcaaattactcctaatgtaagataaggaagtgaaagaatcacactgattgggggtacacttctgagagcacagaatttaagatttctgattcagatgactgaatttatatccaatccactccccacacagcactccatcacccaaacgaacccttcgcaagcacggggtcaggcacatggatggcatatatttaaaacttaacaaatgaaaagtgagctaagaaggaggaatgggggtaatgagtttccaagactcaataatttcaggctctacctgcaaaaaatatgtaagcaaaaaactacaagtcatggctaacaggcaggaaggattaatcaattggtcctgggactaaaggaagataaatgtcagagaaagctacagagaagaaaaaaaaaaaaagtaagatctggcttttttcggaaaacgagaatttcaccacacacacacacacacacacacatacacaaaagggactggagcaacaggtaatgtaataagtgtaaagagaacaacaaagagatttaacacatgctatatggctgttcaagacccgtgggatgcattaagccgtttaatcatcacaagaatctatacagtggcccctactattatctgccccatttttcttcagatgacaaaatcgaggtacacaaaacaaaatcacttgctcaagatcacatagcccctaagtagagaggccataatgtgctgattaattcctgaactgaattttagtagtcacaggcttgccacttgctcttcatccccacgctgtattacctctccaaagtactacaagcaaaagcaaagaggtatgaaagaatgtggcatgctgaggagtctgggaaaattgtctaatgagaaagaaaaaaatgaaccctgagaaaatacacacacacaaaaaaaagcagagtcatctggaaagttagatggagactcaatataaaggatgctgaaaaatgtgccaaaaatttgatgtgatcctgtaggttagggctaccacggaccatcatctactggaatcctcttagaaatgcagactctcaggccccagcccagacacaccacatcagaatctatggaggtggggcccgggaatctgcatttgagcaagcccgccacgggattcttgagcatgctaaagtttgagaagcacaaactttaagaccttgggatctgtgaagagcaaaaatggagagaaaaattggggctatgggattaccacattttagggatagtaaatgcttcagtgatatcagaggggatagcaaaacagtttgagagatttatcagaaggactttgcaggcagctagatagaaaagtaaaggacgaggagcgatgaaggaggattttgagttttttagcttgggtgcttaagatatattaatcttttaattaatattaataattccagagagatatacaggtttggggagcactagtaagtaactcggcccaggtgatggagctagtgaatcccttcagcctttaacactggtgcccaaagaccaaactctattgtgcctctcactcaaacggcagaagatgtccatttaaatcaggacacatcaatgtcaaggatttagataggatcttaaatcagaaatagccagtaaaaagttgaatctagaaggacaggaatactgcaacggtctacatgtgttacagaaacaaggcaagtaaagaagaggtatttccttggccaaaaatagaattcttgctctgcctcccaaatatcagagagcaacgccattgcccccatttcctttagattatggtgattgtgaaagagaggcttcaattctattctttaaatcatcttagggcttgatttatgctgctgctgcgaatgcatgactgacattatcctgcaagtccaaacagaatgcaggcaaactagtgttgcctttgtccggatcaggaggtaacctctcagcagagtgacagctaatgttataacactggaggtttcagcacggtgcacgcaaaggctgggagatgtcacccttctgatctatgctactttttcctgacaaatactatgctaggactgcgcagaaaatgattcagaagaaatatagaaaatcctccccatgtacttattctatctgagctcatgtctgcttataacatggccattaccaaccagaaaacaaaagttctaaggaaggttattgcctttctgcctcaaaacaaactagggagacaggcagaggatgcacaggatgcatgtggggaatagggcaacattcagaaacgtgaaaacacagcagacaattgcacttgtggcaaatttgccttgggtcttggaactgctatctttgaagggccttcacaacagggcttcccggtcatcaggggactttttggtgctgcttcatccaagagggctaagatttacagttgattagcctgcatagttcagttgctttttcaaaagattctaggaagggattatttctgtgcccaaagagcccctagagaatagagaaggctgcttgccggccgtaatgtgaattccccagagtcggtacactgtgctcactgaagcagatgaagtaaagttaaagaagcatttagttcttcagaatgccagccttaataagtatctttttgtggaaggatttaggaggaggggagggttatccttagtgcaggcattatttcctcatacaaaaagggaaaatgtgcatacagttggatgtaaaaagccaacctcgaatgcctgccccccaccccccgccttccccgaggaaaagttgctgaacacacactcccaaacacgaaagcatgaatcttcacagcttaatagtcccgaagccattgtgaagtttctcttgggaaacactgttcattcatctgcgactgaccaagttcaaccattcagctgtgagaactcggagacttgcagccatcaaaagacccaccttcctcagcaagcggaagccagaggagctgcgtccccaaggaagatctcgggaactcgcttctcctctccacaaggatccgttccagccccacaagagaagtctgcagaaggctgaatctgggtgcatctgcaggcagctcaactcttaaatgatctctgcttgcacagttcaggggttgtcctggcccctgcggctctcacagttctccctgcaaacagtgctccttatgtggaatttgacacagaattagtcacttgcaatgagttaaaatgagtatgatttaattagacagtttcgcataagcccaattttctaaccaacagcaacattttcctatttaaaccctgcgttttcttcaacctgtcatcacacaggaatatacacattgacaccaactgagctattgctattaatataatgaacacagtatcgacagagtggccattccattatcgttaaataagccagaagccattcattatacctctctgtgcttaaaattttcagctggggctcctataacttaaggcagagagaaagtctttcatggaaaccaacataaacatttgccacccataagaatagagagaaaaagggacagagagggagggagggaacaattgaacagaaaaaagaaaagaagagaagagaagagaaagagaaagaaagagaaagagagagaaagagaggagaaggggaagaaagaaagaaggaaggaaggaaggaaggaaagaaagagaaagaaaggaagaaagaaagaaagaaagaaagaaagaaagaaagaaagaaagaaagaaagaaagaaagaaaaagaaaggaaggaaggagggaggaagggaaggaaggaaggaaaaagaaaggcaggagggaagaagagaaagaaagagtgcacgagcaagatttacaaagtgcacactttaagtcattttcccccacacaaatggaaaatgaacttacccacattggtagctatgctctgaaaagacccagttgagagaagtcctttctttattgtgtagttttaaagacgattctttgacctctgctatttatgacttgagatctgtgaaggcagggccaaacccctctggctcccatggcccacacaaacaaaagcgccccacctttgttccactaccacatttcccatcaggacaagtttctaccgcactccctgttttcataatttaagttgtgttctcttaaatttttcttgctcagttacagccattacctaatttacaagaggctcccattgctcttttccagtaaatcttttcccataatcatcacttctcagctgaaagaactttggtatgaatatagatgtcttgtcacttcattttgtttaaccatgaaattctggataaaagggttcaagagactaaacaactcatctggcaacatgcgcagccacagtatgatatccttctaccgatttattattttatggatgtgtgcatttatctatggcctttctcactcttaaaataattcaagacaatttacaaagctacatatgattacagctggaaagcacatcttaagtgagtgaaaaaaaaatgagataaagggaaattaaaatggggagaaaataaatactgtcaaggataaagcaagtttcctaaatacatatgatcaatttcagcacacttgttaaagacaggctgtttgatttaagttttagctttctaaagaccaattgtaagaggaaaacactattaactgcaaaatccacagtatccataggccaaaagtatctacccatttctcaaggaggcacaattagtactgataatgcaatcagaatgaatgtctctaggccaggcatggtggctcaggcctgtaatcccaacgctttgggggccaaggtgggcagatcacctcaggtcaggagttccagaccagcctggccaacatagcgaaacccccactctactaaaaaaatacaaaaattagccgggtgtggtggcaagcatctgtaatcccaactactcagaaggctgaggcaggggaattgcttgaacccaggaagtggaggttgcagtgagccaacatcgcgccactgcattccaccctgggagacagagccagacttcgtctcaaaaaaaaattaaataattaattaattaatatctctccaagtttcctccccaaaatggcatgacataagagaccaatgtcctcaacaactttcttagagcagccccaacgactaggtttgtaggacaatttctgaggttatcatccatattgcattgcagcaacttaccattcagcaaaagccatttgttaaaggaagatttgaaatggcaaagacatagcttagccgtgtaatcaaggcatagattctagagcacctggaagtgatacatccatcaggcaggtataaatactgtctctctccagtggcttttggtaccaccaggatacgatgagtttcatattctactacttggaaagttccagatgcctggtggctttgcttatacttcattgtcacttcatagctagcaaaactttcattagctctgacattcactgtgaaattaaaggtcctaacagacatttgtctaaaataaataaataaataaataaatacataaatattaaaaaaaaaagcaacccacttcctgcatagatatgcatcaaatagggagaagggagtatctgacaaaaatcctcctcagaaaacgtgatttcattttccaacccagaagaaaacagaaggtgtaatccagtaaacacacacacacacacacacacacacacacacacactgattacccaaagaacatcatgttttgagtagtgaatcttacaaggatattcttagacctaaattagttggaaaataaatatgccaaggtggttgaatgtcattatttatggggcaaggcaggttcttccccattgaatagataaaagatctcttgagaaaggcaaattgttttagtttcaaacaattagtctatattctctttttcaggcaagtgagacagcaagagtttctatgttcacccagttggtaaaaatcgagtttaaattaaaacctccatttattttcctacaatgactgctctttcagaaacacagagaaatgaaaagtttccaaagtagactacgcacaaacacaaattaggttttctaagaggaactcctatgtgtgattcgggagacaagtagacttgaacctcattccaacgattacgtataaggtggagtcaaaattatgaacatagaaaagcaaatgtggaccccccttaaattcaagtgagagttttctaccccagtagagaatattttgacagtgactgtcacggcagagataaagcaacatgatacaatctcatgttcaatgcccacaaatgctgatctaccagagactgaaatccaattctgtctcctttctcaaatataagggtccccaaacttcaatcagcattggtgcatttttccagttgccagaataaacctcaacatcttcaaacaagcggtgctcatccctgctctgcgtgctttctgatgaacacattacaacttcaaaacatctgtcagactgtaatcaccatgtaatgcatcttgactcagatggttttcatatgttcaaaacagattccctttctaaaggcagctttatggaactcgtcttcaactgtgaaccaaataagagatttcgtttgcattttctttcatcagatggaagaagaaattaatcgtaagagattagggaaagacttacacggaggtgcatttccccttccgcatgtttttcctttgaagtttatagcaggtggaagagtctttcacacccgtaaaattgacatggaaaagcagaaacacactgagctattaacttgtcacatattggatttaaatctaaataggaacccgttctttcccttatatattgattgtgtaccagcttagcaggaagctttgcatgttctttcagcagacaggctagtttctaggctaaaataacctggaatgtttcagctaccacaggctaatgatcacccaaatgcacactaatatgtttgataaaagttctcagcgtgagggcagaaaacgcttaccatgagaatgacagtggtcaggggaagcaaatcagtgacaccaactcatgccgccttcaatgctggaggctccaattagaactgtgagtctgcattccagggggcagtgacagatggaagtttgcagcaaatctctaattgtttaaatcattaactcatccatccacctgcattatcactagaagggaccctgctggaagccttcagtggtttctcaaaaatctcaggactatttcctggccatttaagaaatggtgttttgaaactagttgtttatgtagctatttgtgagttctttttttatctttttcccaggctctcatttttttctcttcttttttctttccatttctgcctttgcatcagagatgatagccactttaatgtccttctagagcaacaatggatgaattacttataaatcatgccacacgtccagccctaacttaattttcaattccatcaactcccttaagacagacttcaggccggtctccgtggctcatgcttgtaatcccagcactttggaaaggccgaggtgtacaagtggcttgagctcaggagttcaaaccagcctggacaacatagtgagatcttgtctctacaaataataataataataataataaattacccaggcatggtggcacatgcctgtagtcccagccactcaggaggctaaggcaagaggattacttgagcctgtgaagtcaaggatccagtgagccgagatggtgccactgcacttcagcctgggcaacagagcaagaccctgttgtcacacacatccgtgtgaagaaactaccaaacaggttctgtgtgagcaataaagctttaaaaaaaaaacaaaaaaaaaaaagagagagagagagaaagagagagagacttcatgtcttactaagcacaaaacgccaaggctacttataattatcttgtggcatcatgctataggacagttggagaaatttacatccagtggtttatattaatcatgctaatataatattgtacataagatggctttttcaaaagaacactagttgaaacctcacacacactaacaatttcttttcgcatgcattctacacaaatgttaagaccaaaatgttggtttaaggaaataatagaatatttctcttatctcttctaatgtttattctcacatcatatttattttctcctgaaaaataaagacatgatctcatgtaagtaaagacatgtacttgtggaaataataacattaatatccaaaatgaaggggaattaattatacccgacttgagacattttctgcacaaatctctctctttgaattacacaagcctgcacttctcctgaaatcattgtcaaacgtgatttggctgtgaagtcattgtttgctccaaaggagatcaataagttggacaacagatgcttggtgaacagcaacattattcttgaaatgtatcatatataaagtcaagagatattgtataagcatcagtaagtattgcaacaggtctaaagtatctaaacatttaaaattttgatccactacatattagaattgcaatcagataaaaaacgttcacctttggttcttgggtactggggcatggtgcattttcatgtatgtctgagttttcattttgctcctaagaaatgtcttccttgggctctatggatttacagtcattaccacataaatcacagaaagcatctcatacaaaacaaaaatttccacagtcatattcagatgtgtttcagaggtttggccctcactcgataaatttcacagatggcaaatgaagctgtccagatttttacacaagcaaaaccaatcttcctcacctctaaacgtggttctgaataaagctggaaaatcactaacagttaggagttgtacccttataagaactgaactcccactgagattaaagctgtaagccaaggcaccaagactgggccctaaattaccacttttcaacacatacactccaaaccaaatggggaacaaaagtcaagccagtgagttctggcactcaaaggcagaaagataagcatgcaggctccccacagataggtggttgttactaagtggcatgccattgtttgttagatgcaaggttttgaaacataactctgagctgaaagttaaaggagaaatcttttttttttttttttgagacagagtctcaatctgttgcccaggctggagtgcagtggagcgatctcagctcactgtaacctccacctcctgggttcaagtgattctcctacctcagcctcctgagtagctgggattacaggcgtgcaccaccacacccggctaatttttgtatttttagtagagacggggtttcaccatgttggccaggctggtcttgaactcttgacctcgtgatccacctgccttggactcccaaagtggagaaatattttataaagtgaagacaagactcatgcaaatatcagatggaaatgtaccaaagattttatttaactcaagaaatagtcatatgttacatttgattcaaaggaaaaatcccatagataaatagacaatagacagataaatgatagacagattaagatggatggatggatggatggatggatggacggatggatggatggatgaatagggtcaataaggaatgctggtgctgaaatggatttacaaatatatgcaaaatgttgtattcctggatgaagcatcaagtgcattccactagacaaaatgtatttgcattttcatggacaagagttattttcattatcaattttctaccatttgcagagtgggaaaatagttcaaagcactgaacactggacagaacttggagaagtgcaatacagagaaaaataatctttacttttgccaattttcaaatctttcacaatttttcttgactctgatcatcacattttaacactggattttcaaaaattagctgtgatttatttgaagtttttttttcactattgtttactattcattatttcaaatccctgcagtttgacaaacaatgttctataagctatgtcagaaactgtccatttttgtttgactttaaatattttaagatatgtctttgtattgtcagaagaatgcatttttattgttttgtttgggtttagttttgtctgtgtgaatgtaatgtcatagaagaggggttgacaaactacagcagcaggccaaatccaggttgccatctgtttttgtagaaccagtaagctaagaatggttctttcattttcaatggttggaaaaaaaataagtaaaatattataatgtaaaaattacaggaaattgaaattttactatctacaaaaaatgttttattggaacatagccactcttcttggtctatgtattttctactattgcttttgtgctgcaacaacagagttgagtagttgcaacagatactttatgggctgcaaagacaaagatggttactatctggtgtttttttagaagtcatttgctaacccttatcctagaacactgcatttaatgaaaagttacattgaaaaggatgatgggattcaggacacactactcaaaatacggcaccttggcatattaaaaaaacagaagcaggaaagtctctctgacctcccctcctcacccacacatatgcttctccccgatgcagggcatacagcttaggaaagcttttccaacattcccaagaagcaggtcagaagacactcatgtgagggcctcccgatccctggaagaaaggaacatgctcatctctgaagatgaagggtcacagagaggaacctgaacaaacaggccttgctaaattccccagtttatctacactagatcacaccctttttgtcctatcatatctctccatcagtattcactcttcatcaaagctactataaaaatacacagaattaaccatttactggagtcttcatttatttaggaagactcccacagcatgtaaatcttactaaataaatttgcaagtttttctcttcttagtctatcttgtgttaaaaggacctaagtcatgaacataggatgggtagagagaaggatatttgtcctcctctaccagaaaaagccactgggaaacatagatgttaacatggctcattacaatattttgactctgtgctatgactaaacaccagggcatcttgcccatgaatttgaatttcctgtcaaatgctccaaatcattcctaagtgggcttttagggaaattacatacaatgaaaaatagaatgtaagaataagcatttcctctgagctggaggctgtctttggctggatatatcattgcttcaggcctcaggttcctgaagcgcacaatgaaagaattgcactggatattcctaaatattctctctagctttagaattcttctctccatccttcatgcaaacaatgatctcagtggtctgtatcacctatgttcccttactgagaggagccatctaactcttaacatagtcagtcctaggatccatgtgtctgtggctcactcaaatagttttctctttcttcatcaaatatttccatcccagagtaccaaataagttacgaacatgagaattgagccttaagaccatgagcagagcctaacagaaactgggtaattcacatattaaccgttaatgggtgagtacagaggaacttcagaatgatggaaaagagttagaattgtgagattagcaaagagaaaaagcagaaatggattctaaaggtacacaaatgctctaatgggcaaagtaagggggagaaggtggttatgtccccattggtacagtaatggggactcataaggaatattgcatgaattttttttttttttttttttttttagacagagtctcactctgtcgccaggctggatctcagctccctgcaaacttcacctccagggttcaagcgactctcctttcgcagcctcccaagtagctgggactacaggtgtgcaccaccatgcccagataatttttgtatttttagtagagatggggttttaccatgttggccaggatggtctccatctcctgcccttgtcatctgcccacctcagcctcccaaagtgctgggattacaggcgtgggccaccgccccaggctggaatattgcatgaatttttaagaatggatgaagtaacaatatctgggaattttctcagtgagcaaaaaagtaaaaaattaatgcaaagaccaagttcacccttcatatcactttatcactagggcctagggcatagtagatgctcagtgagtatctactgaaatgggattaatcagactctattggaacgagcaaatgaaatgcatttaaagaaaatgttaaactagaaacataaataaaagggctgaacagccacaacattataatatatgggaaaaaataggatctgatttacattatatttggcatggagtaatttgttatttaagagaaaggttaatgaaaataggttcttaaagtaataggtcgggcatggtggctcacgcctgtaatcccagcactttgggaggccaaggtaggcgaatcacttgaggccaggagtttgatgccagcctggccaacatggagaaaccctgtctctactaaaaatacaaaaattagccaggcatggtggggggtacctgtaatcccagttactcaggaggctgaggctggagaatcacttgagcctggaaggcagagttgcagtgagccaaggctgtgccactgcactacagcctgggcaacaagagcgaaattccatctcaaataaaataaaataaaagtaatgtacattgttaagattggaccaacttaaaaatattattagaatggaaatatatcacgttttatcagtatgttttacattactatagtaatatttcattccaaaaagtatttagtgtggcttggactgaaaaaaaggaaattaagataaaaattgtttgcaaaacatatttagatagaatttttaaaatacattattttttatgccaaaggtgtatatttactttcttgattagaaataggtgatcttattacttacttactactaaaattgaactactaaaaataagtgattgtaaaggcatctttttaggatagatttgatatattttaaaaggcttggccaggcatggtgactcacgcctgtaatcccagcattttgggaggctgaggggggcagatcacttgaggccaggagtttgagaccagcctggccaacatgtcaaaaccccatctctactaaaaatacaaaaattagctgggcatggtggcaggtgcctgtaatcccagctactggggaggctgaggcacaagaactgcttgaccccaggaggcggaggttgcagtgagcagagatcatgccactgcactccagcttggcacacagagcgagattccgtctctaaattaataaataaatggtttgccctgaatcatccgagactgaaactgtgtttagatgtcagttttgcgaacagtttattctggagtggccaagggcataccacattcttatgggttaaatgttctctcaacataaaaaataaagaaaagaaaagaaaaatcaccttaacggaggaatatctaaggaatctatttctccgggaatctactatgtatccctaaatgaagctgaatcagaagagtaggccatctttaggctgtatctttctgacttcccaccagacaacaggaacataaaagcaagaaagagaaaatatggctcatttgctagaattgggtcacagttttgccaggaagttacactattcacagtagctataagggtggaaaaaaaaaaaaaaaaaaaacctagtgcatcaagacaatcaaccactaaattgagcaggagatctttcataacttttaaaaagttattctataagacttcatatgtgtgaggtatacaatgagaaaatcactggcttttaattccaccggaactcagttcaaatcctgtgtaggggatttactggtacttattagtaaagtgactttgtaagaaagtcacccaccttttctgagcatctatgacatgaaggtggtcattccaagatgaagccgagattaatttcactcacacacaattccatcttcatagaacaaaagaaatgtgaaataacagtaacttaagcaagatagaaaggtatttcctcttcatgtgcaaggctggtatggggccccacagtatcaaagagccaggttccttctatctttcttgtcagttattctcagcctggactccatcctcaaaagtacctcatggcccaagagagctgctggggcccctgccattggtatgccctctaagaagcagggaaagacaaggggaagagaacaaatgagtgcattttctagctaaatcagttccctttaaaagaggcattttgaaatttcttcacaatgattccacttgggcaagaaattagttactggccatatttagaagcaatggagcttggggaaatatagatgtttaacacaaggtgacaatgtgctcaggtgaggaatgagctttcgattagcagagaagaggagaaaccagattagcaggcaaagagcaatctctctcaccagtgttacagagtacatgatgacaatcagaattcctagacataatgagcccctaaaaaggtgcttggcacataccttgtactcagtaaactacacatttattttctttcataaataaagtaaaactgctgaggactatgctcttaatttcttttataacttcacaaatgtgtagaccagagtttgtcaatctcagcattactaatatttggagccagataatccttgctgtgggagggcttttctgtgcagtataggttctttattagcatccctggccttgacccactagatgccagtaactcctcactcccaactgtgacaatcaaaaatatttccagccattggcaattgttcctgggggaggaaattgcccttggttgagaaccactggcctagacctgtgctggacaataggcactcttctatattctctagggttgagtggtgcaggggctaaagacccttgagctcatagtgctgattccattatgtggaacccagcatacccgaagtcagatgaagcacagagacgaatctctacagttaaaatgttttcttccagcctggccaacatggagaaactccatctctactaaaaaatacaaaaattagccgggcatggtggcaggcgcctgtaatcccagctactcgggaggctgaggcaggagaattgcttgaatccgggaggcagaggttgcagtgacccaagattgcaccactgaactccaccctgggtgacagaacaagactccatctcgaaaaaccaacaaacaacaaaaacaacatcaaagttggggacagagcacaggcagtcaagagacagccagtgagaatcagaatagggctttggattttagtctgagtgagacggaaatgaatcattaggtttaaggtagacagcagtgtgatgccacttatatgtttgaagggtctttccagcagccatgaggaaatgtgattgtttggggtcagagtggaagctaggagacccatcgggttgctcttggattcatcccagacagagagaatggcaggttggaggtgggaagagtggttagatgagatctattccacaggggctctgaaggaggagctgacaggctttgcagatggtcaccagaagtgattaaaaagtgtgtggtttctagaaaacattatgcaaacctaatcttttaaaatacatcatcggaaaattgtagcattaacactgcttctgacttttctgagttttctgacttttctctccctatatttgtacaaactggtttctagagttgttggcctgtaagaaacacagtgtagaagacagggatgtatatgtctctactggtttgttgagtgattacagaaccatcatcaatatgcacatgcctgaattttcccatttgtaaaactgatgactatgtgactacggattaccagtaaccttattaacctacgcattaagagaaaaagcccacctagtacttcatgaatcccaaaagaaatgcaaattgtaattatctgcacaggtatccagtcatgctaacatccaaaggagtcaaactctgattaataagcaagattcattcccaaagattcccaaggatcccaagttaaagacaacccttcaatttctgtcagctttgtaatatattccagagtttcagttgggcttaattgtgacttattgattgatttttgctttctgacaaaaaggattgctttctttccttgtgaaattcaaagtccctcatggcagccttgattaatcatttgcaaaatatggtttaaccatctatgatccctagtgtacaaatttctttcactgcaataattttaaagtaattcaaataagcctgttctaatcaaattccttataagtctgcaaaagataatttcttgatggaatatggaaaaaatgagtgcttaaataagaagtattaccaatgtaacaaattatcattcctataatacacgattaatacgacactgcacaaaaagaatacttatgaaatttaatcagcctcatagcattatgtgctttatctggaatgatggcatgaaaaagttatctaaaattccagttgaagaccaattaatataatcaataccagaaaatgtctggacagaacaaatgcttaggacattacataaaaagagtaagtggaccgtaaccaggcatttcattcctgcctagtatctagacagtcagagataagcaaagcttatcttcatcaaattatttaacattcacgtaggaactctgttctattttaaagtaacactcatgtgtattcagtgagcatgattgtggaaatgcatcattagaacaaagtttttggtttaggaatattattctataataatttattgtatgtatttgaaagacctttcacaaaataatccttttcataaatatgctatttcaagattattatatattccttagattacttgttgtttataaaataaggtgtacttctattttaggactaaaagtaatatccatgaaatgaattttatgaaacactattatgatcccaaagttttgctccaatgtttttagcaaactttgtaaactttactcatttacataacctgattacgaaacctacttcagactggagctagagtaccatcatatatatatttaaaaaacaaagattttggtgtattgggattgaggtaagaattgtattatatcaaacatataaataagtaacataataaagtttatagtactttagtgtgcagcaaagaatactcaaaaatggaagagagactctttaatgaaaaaatcaaattatttaaccagcaattcctacaaagaaaccaaaatacatgcaaaataacataagtataaatagaatacattaaatcttctctggtctaaccagagggcattttcttcttaatgttttttaacagaaaattacaaacaacaataaaatacagtagtatatagaaccattgatacctgcatcttgatggcagtggtagctacgtaaatccaatcttacacatgataaatgtcacaaaatcatatacatacattgcatgcatatcaattttgtgcttttgatattgtttacaattacttaaagtgtaaccattggtggaaactgggcatatatgatttctctgtgctgtctttgcaacttactgtgaatctataattattccaaaattaaaagttttttgcaccattcatacaggtataggaaacgtaccttagaacattgcttgtgattctggcaccaaaccagggaaccattgttctgcaaaaagaaaaaggaaaaatattgatccattagaaagctacacatacacagatttctaatttaaaattataatttatgcatataatttttgaatatttgcattttaacaaatacccaatcttgcaaaacctgctgtccttcccttccaatgatagaaaatgtgtttgtaagtttcattttgttgtcgatttcatgatgtaaacaaagacatataaaatactaaagattctaagctgtctgaaatgaaaaagggtctgaggcaactttgatggtgtgttgagcagtgaagcaggtaaatgaacactagacgttccgccaatagtcagcagttttgagaaatttacaacttaagcattgtggatgcttttgatctcaaccaatttacagaaataagagtttgggattgggagaaagatcttgtattagtctgttcttacacttctataaagaactacctgaaactgggtaatttatgaagaaaagaggtttcattgactcacagttctgcaggcttaacaggaagtatggctggggaggctcaggaaacttacaatcatggcggaaggcaaaggggaagcaagcacatcttaccatggcagagcaggagagagagagagagagcaaaaagggaagtgccacacacttttaagccatcagatcttgtgagaactcactccctgtcatgagaacagccaggaggaaatccacctctatgatccaattacctctcaccaggcctgtccttccaatttgacataagatttgggcaggcacacaaatccaaactacatcagatcccacgtgaaaagccttctcttactctttcacaaaacatatgattacagacaagagacttaacatccccatgcctcagtttatccatcagtaaagcaagcctaacagcaatatctcatgcatcaggccactggggtaactaaatgaaacaatagatacactcaatatataacaaatatttggggccgggcgtggtggctcatgcctgtaatcccagcactttgggaggccaagacgggtggatcgcctgaggtcaggagttcgagaccagcctggccaacatggtgaaaccctgtctctactaaaaaatataaaattagctgggtgtggtggcacacgcctgtaatcccagctactggggaggctaaggcaggagaattgcttgaacctaggaggaggaggttgcagtgagctgaaatcacaccattgcactccagcctgggcaacaagaggaaaactccatctcaaaaaaataaataaataaataaaattgtactatgatttattatcctgaacattagaattgctgtattccacataactaagattttggtgatttttttttttctctggttgggatcttttaagtcaggttatgctaggccggaataggtagcaaagctagcagaaaccatcacccaatagctaaaatgtcatgacctctagttctctgaagttcaaggtggagatgaaacaaaatctcccatttcctatgtttgaacgtctaaacttttaatatgaaggataccagtattgacagagcaagatgatatatgtttgcagttatgagaaaagaaaattgaaccaaaaaatatcttttagaaaatacttttataacaagtttattgagatataattcacaaaattcactcatttaaattgtacaacttgagtatattcagaaagctatgcaaccaacaccactatttaattgtagaacattttcaccagcccaaaaagaaacctgtacctatttgtaatcactcccattctgtcttccccactacttgccttaccctggcaaacactaaatctgcttctgtctttatctatttgcctattctggacattttatataaatggaatcatacaatatgtgtctggcttcttgatgctaaatgctacagcaatcttgcttcatgtacattgtagtatatattggtacttcatctttttgactgtcagtttcagctacatggatataccacattttgcccatccactgccaataacatatctgaatatgtcccttcccagtaatagcttaattataggatcccccccaaaccactaaataaatctcagctgtataggattggcaatcttcttcttcaatgtgaagattattggcttaaaagatctcggtcccatatgaatgctttaactatgaaacctctctagcatatagccctactttttacttcttctcagccttaactcctaataattcctacacattcttaggattttagccagccttaactcccaataattcctacacattcttaggatttgagccaatctcctatgaacctacctaccacctactgagttccgtacgtccacatctgggccctcatctctccccccacatctatgtcccccatagagacagtaaggtctgaagctggagacgcatacgaacagcttagggtgaagttcgttatgatttttggcagggattacatcagataaataattagattgggcagaggccaatgccagacaaatgatgggcgtggttgaattaccggaaaatgagatgttaggagaaagcatgtaagagggcataacatacccttttataaaactgaaattttataaagggagccattggcttggttataagctaaaagttcagaggggccaggctgactaggggatggtcataaacagtgtgacaactgcaaaaagcaggggccaggcattgagcatgcagaagctgggggctggggcagggcagctttgaagaacttcctacatgacagccagcctcagcatgttgcacggtgtgtagattcatacaggattggctaaaatcctaggtatgtgaaggaattattgggagttaaggctgagaagaagtaaatattagggctatatgctagaggggtttcatagttaaagcttcccctgcttcccctgtgcagagttggctcctgccaggacttccaaggacgacacctgtctgagcacatcctggattcaacttgagtgttccaagctcctccccaaccagtgatgggaagcaatgaggcaccttctaaagagactcagggctgaagtggacagcctcagaccttggagactaggtcaaagccagttcctgaaggtctttttcagcaccatcttggttggaaggttttgagtcttcttgagtcaggtcagtggggttctgctccttggactagaatccttgacatgggcacaggtgagacctccttcccttctggatgtttcttttcctaggcagatgggcaggaccttatctctggatgagatcaggggaccctcagctatttctgcacttgctggattcctctttggagttttatcacaccctctcctgctgaatgatatgctttattttgtctgtgtcttggttgctcaactagatttttccctggggacaggattccatgtttcctctttacctgtctgtaagacattagcaagggagggcagctcttggtcctcacagagaaggcacatttctgaggccatgcaagagtgactggggttccaaaagtgggcatggcaactgttgcctggggttccaaaagtaggcacagaaactgttgtcaacaggttgacaaaaatatcactaacgcggcaatacacctttgactattattattattatagtggccaaatctatgtggcagaaatgtgccttgatgttttaatactcaccccatgtaatcatcccacaaaatgacataagcttcatttattcattttacagttaagaaacctgtagtcagggaaaccaagtaaaatatgcagagtgacaaagccagtgattaacctcaatggtaaacaacacaacaggaaaagccacaggtgaagaaaggaacaagatgcacactcgattttgaaggaatttccagatttataaccttaaaaggagagatgaagattggtccaacagtcctaaataccatatgttgaggtagcagcagttcagatggatggggtggagcagagaataggaggggagatcaggtaaatagaaagtagattgcaggattttcattacacaagattttatctctggaaataatatttttaatttagcaaatatcagagagttaattaaaacaaaaataaaggattagagtcctgagaagccctgtgcaggacacaccttgatatggtttggttgtgttcccacccaaatctcatcttgaattgtagctcccacaattcccatgtgatgtgagagggaccctaggagaggtaattgaatcatgggggcgggtttttcccatgttattctcgtgatagtaagtctcacaagatctgatgggtttataaagggcagttcccccgcacatgctctcttgcctgccaccatttaagacatggctttgctcctcctttgtcttccaccatgattgtgaggcctccccagccatgtggaactgtgagtccattaaatctctttttctttgtaaattacccagtctcaggtatgtcgttattagcagcatgagaacagactaatacacaccttgattagctttcttttgttcccttctactgtgtatgttgaatggccaaacttcaacaacaaaagcacaaaggatgcagcagagattgtcttcagctgcccaacctccccttcccaagtgtaaaccctcctgccctgccccacaccaactctccttctttcctgcaattcaatgctccccataccattggcttatacacacccatcaaaatgagaagaaagccaatagccacagagcctattttgaattgggaattaatatcaatacattgcgttgagcaaggcattttcatttcaagcaaaattttctactaatcacaaaatgaaaaactctgtcattacaaagaaatatttggggcaatggcaagcatgcataaacaattattatgattagaatgattttttaaaattagtgaggacagcatgtcataggctgcttgggatgattaaaaagataatccttgtaaagtatttatcaaaatgtttggctcaggatttttaaaaaatcctttgttattattgatgtgattttgttgtcatttgccattatattgtctttagcagtttgggagtaatcctagacttaatatctcccagctcacaacggataatactcaccctagactaactgattcagtcttattatagtgagactcaaaagtatttagtattgaaaatactaagatacagtattttagcaatactaaaatacaaataaaacttgcagtaaaaggatgcctttccattctgttttttccttgggtggaagcaatttttcaacatttgccaacaggatgagtgggcaatggtattggtatttttactttaatttcctgactggccatttattttcctttaccgtggatagtctgtctcttttaccttatctaattgcggattgttcaccatttttaaaatcaattttagcaactattagtatcacttaggttcaatgatcatttgtctattgcaaaaattctcaagcccctcattcatcttttgcatttatttgtgaggtttttccacaaggaaattttatatgcatgcacacacacagatgcacgcatccatgcattcacatatatatttgccctcaaaatgcatccatagttcctttttggattctgggtttcctgtttttcttaaaataattgcccccatgccaaggttttgcagccgttctgtgcttttacctgtatcagtcatcatgtgctgtgctatttatctctactaagaacttctaagaaccctgcccactagcatcagggatgccaataaacccccgattaatgctggccactttgtttaggccagatgctaccccatcacgatccacctatgttgcttacatatagtactctttgagcagaagagcaataaaaaaatacaagaatccagtatatttcaataccctgccccagcagaagtccttcgtcagattacaatagccttcaccagttaagccatttgacaacaaagataaaataacagtatttgcaataaagtcttgttctggcttaaagccaacaaagataaagagtcaaagtacattaggctagaaacacatttgcctctagaaccatcattgtaacctccaggtaggattagacagtgggacttttgtaattatataaagattacatcctgtattttattggtttaactagatcaaacatgaatgctagtcaatctggctttcaaagagtttatataagttcaatcaactgcacccagccgttatttcaatgacattttccaagtcttttcatttctagccttttgatttttccttaaagaaagataactcttcaaaagcttcaagtaaagaaaacacatcattcatgcaaagacaacacacacgggaagaataaagataaatggaaactagttctctagatcccaccatatgaaaagagaaaacaggaacagatctcactcatttccttcaacatagccaggtgtcggcatggaacagctaaggaactagtcagtctacaatttccaaaatacataccaaactagtgtctaacaatggaactgaacatttgaaatagaaatcagtcaggaaacccaccatagaccttaactttaccaatcaatgctttgacactgcaaataattagctgtgaccctgaatggacaattttgtgtcctgcttggtgtaagttattttaaagcaatagatgaaactatagatacaagtcattatatatttgtccaaacccatagaccatacaacaccaaaagtgaagcgtatgtaaactatggaccctgatgatgatgatgtgccaacgtaggttcatcccttgtcacaaatgtcccactctggtgggggatgttggtaatgggagaggctgtgcatggtgggggcagagagcatgtggatattctctgtaccttctgctcaattgctgtgaacctaaaactgctctacaaaataaaaagtctattgaaaaggttcaggaggagggctttctttatatatttgttgttcataagtaagatttctttcaaatgttatggaatatcctcagcagtcttttcattaaccaagaaaaaagtctctctgtattctacaaatatttcacatttaatggaattctacaggaaacaaatatttgaccatatagaaagaaatacacctgcctccagacacccagccttcccatactgtcctttcttcaaagaaaatgcgacttcaaccaggaagccttccctgacccccacgccctgacttccacagctctctctctctgttgcttgctctataacgttctgcacttctccccccaggcactctatcacacagtggacaagtgcaaattatgtgtgttgttttaatttaatgatcatatgccccccagcctggaaaagctttggcggtagtgtctatccctagcacatgtttgccattggctctctggcacatagcagcgtgcctgacacagagtaaatggtcttcacaaatggtactgattgaagaaataaatgaatggagtaggaggtcatacaaaggaatttaagctttagttattaggtcctgaggagctagaaagaatgatataaatagactgagctgatgaaatgtttcatcttctctggatggagcttttaagaagtaggctcattattttgtttcctatgatgtaaatgtccaagagatttggcatgatgacaccgaaaactgaacaaagacttgcatttgggatcaaatatacgttatttaataaataaaaatactaattatctttttatagggtgtagatacagtacctaaagaaaatatatagaacagcaaatgccagacttttcttcttctcatcattccctaaacaatacagtgtaacagctatttacatagcacttacacagtattaggtattataagtaatgtacagatgattttaaatatataggaggatatttgcaggttatatacaaataccacaccattttacttcaataacttgagcatcttcagatgtaggtgtctgccggggtggggaggggaggcagatcctgaaacccttagggtgcattataactttgatatacttttcctgaaactaatagaattgtgttcttcaagtatattcatccaagaagaacatactgttgtttcaatgtaaccagcagttattttccacctgtacttttaaaaccaactggccaggcatggtggcacacgcctgtaatcccagcactttgggaggctgaggcgggtggaccacgaggtcagtatttcaagaccagcctggccaacatggtgagaccccatctctactaaaaatacaaaaataatctgggcatgccagcacatgcctgtaatcccagctactcgggaggctgtggcaggagaattgcttgaatccaggaggcggaggttgcagtgagctgagatcacaccactgcattgcagcctgggtggcagagcgagactatgcctcaaaacaaaaacaaaaacaaaaaactttagggggaagctgagtgccagacagtttaaaggaacaatagaaatgcctaagaaactatcatcagagtgaacaggcaacctacagaatgggagaaaaattttgcaatctatccatctgacaaagggttagtatccagaatctacaaggaacttaaacaaatttactagaaaaaaatcaaacaaccccatcaaaaagtgggtgaaggatatgaacagcacttctcaaaagaagacatttatgtggccaacaaacatatgaaaaaagctcatcatcactggtcattagagaaatgcaaatcaaaaccacagtgagataccatctcacaccagttagaatggtgatcattaaaaagtcaggaaacaatagatgctggagaggatgtggagaaataggaatccttttacactgttggtgggagtgtaaattagttcaaccattgtggaagacagtgtggcaattcctcaaggatctagaaccagaaataccatttgacccagcaatcccattactgggtatatacccaaaggaatataaatcattctactataaagacacattcacacatatgtttattgtggcactattcacaatagcaaagacttggaaccaacccaaatgcccatcagtgatagactggataaagaaaatgtggcacatatacaccatggaatactatgcagccataaaaaaggatgagttcatgtcctctgcagggacatggatgaagctggaaacaatcattctcagcaaactaacacaggaacagaaaaccaaacaccgcaagttctcactcataagtgggagttgaacaatgagaacacatggacatagggaagggaacattacacaccagagcctgtcagggggtggggggtgaggggagggatagcattaggagaaatacctaatatagatagatgatgggttgatgggtgcagcaaactgccatggcatgtgtaaacctatgtaacaaacctgaaagttctgcacaggtatcccagaacttaaagtgtaattaaaaaaaaaaaaagaaagaaaaagcagtacatatacacagtggagtattattcaaccataaaaaaagaaatgtctttaagaaaacaaatgtcaatttcatttcaaagttcttgtgaataatgaaaatcatcaaaggagaaaattatgcaagaccaacacagagagaaaacaatattaaataactttacatgactttgaattacattgttttcttttcttttctttcttgagacagggtctcactctgtcacccaggctggagtgcagtggtgagatcacagctcactgcaaccttcgcctccagggacattcttcaccatggttatctgcaaagagtatgacatgatgcgaatatttatctggctatagtgtactttaggtgatacgtaataactagaagtgttttgaagccttcttaggtcttgtatttccttaactgttgtaggtgttgtgttcttaatataggatgttttataaataaatataactaaaaattcatcaagaaaaattttagcagaaactaaagttgcatagactaaaactatgacttgcgacatttcttagctacatcaggattcaaccttgtccaccctgggaaaggtagtgtgcaatagctgctcttatgcacaaatgattgaaaaccattatttgtgttatcttataatttttttttatttttttgagatggagtctcgctctgttgcccaggctggagtgcagcagtgcaatctccactcactgcaagctccgtctcctgggttcacgccattctccttcctcagcttcccaagtagctgggactgcaggtgcccgccaccacgcctggctaattttttgtatttttagtagagacggggtttcaccgtgctagccaggatggtctcgatctcctgacctcgtgatccacctgcctcggcctcccaaagtgctgggattacaagcgtgagccaccacgcccggccgtgttatcttataaatttatgagggcttttgaaattccgattttatagttaaccacatgagccacataggagtccagagctctctgagaacttctacctcaccagcagtccttctgtgcaaagtattttcatcaatgggcattccggtctctgtcaaagtgtaagatctatttgaatctgaccaagcctgttctctaaacacaaccaggataagaaaaaggacccaacaagtgattccaaatacccactcaaaatgtttgtaaatggtagcattctgactcagatgataccatatcattacaactcagagaagatctttgagggccattcaatccatcttcttggtgaaaacaagacaaatgtaactcgttaatgacatgtcattgtctcataatacagggaactttccaaggaaaagaggttacagtgtccctgtaacatgttactccgctatgctgacttttccatcctgaattcctagcgaaatctctcaaagccattcaagggaaaaggggtgaggagttgcaagtgatcaactttcagattttctgcctgctaatattttattctctgattaactaattcatctagtaactctctccaaaacatttaccatgccaaaggaaaacatcaaaaccagaagagaaaaacacaatgcagggaccatcctgcctgagtgtgaagaaggaagatcacacacatattactgaattccataatactcaagggcaggaccaagacgatgacacaaaccacatcatggaaatgagcatatagtggggaacttagaatttccactaatgtctgaggagaaaggaaaagcaaagaatggggttggaggagaaatctaagtgtccaataaacctcaaaattaccatgctgaagaggaatctaagtgtccaatgatagctctaaacctcaaaattaccatgcctaagactgtcccaaatcatcaggttagtcattgtcacacatcagaataacatgtgaaagccactggcaacagtggcaacacaagagtcagaggaaaattctacatcctgagaatggcaagttaatagcaattcaagttcaacagtctccctttgtagatgagtcaattggggctcaggaaggctaaaaaatgtatgaactattactgattcaaacacaaagaatattttaatagtaagcacaccttacttaaagtcaaaggctttatttcacatgccaggctactactcatccaccatgggtggtaagctctcagaaaaattaatgtcttcttttctcaaatgagatgaataatgtctttacaagataatcacagagatgtctatgaaaaccacctgtgaccatccaaggtcaaggctgtagtctagctggcaagatgccaagttcagtgatatgaccactttgcacacaaggagtgactttcaataacgtagaaggtctcagagagctctggggccccacctggaggttgattaatcccaattaatcatgcgattagccatggagaagtcagaattctaaaatccctcagtaagttttgatacaacagtaaagaaaatggtttccagtgccttataaataagagcagcctaattaatttctacattgtatggttgtttcaagtctttgcaaaggcataatatccatgtaaagaatagaatctatacagttgtttaatgcaaggtcacactaaattagattcacatatcaaaaccccacttgggagaacatgaaaatgcaatactgtcaagtgctattcttagtataatttcaaattcacattgaaatatatgactttgtttcctacggctgccatgacaaagtaccacaacccagggggctgaaagagcagaaatttattgtctctcggttctggaggctggaagtgtgagaccaagttatcgcaagaccatgctctctcagaaaggccataggggaagattggctccatgactttctttgagcttctggtagttccttggcttgtggcagcattccaaccttcacatccgtgtcctcacatctctgcatgtctgtgttaaaatttctcctttcagtaaggacaccagtcatattggattaggggcctaccctcctccagaatgactcatctcaattaatcacatctctaacgacgttatttccaaataaggccactttgtcactttctgaggaactgggggttaggacatcaacatatggagttagaggtgcattattcaatccggaagcgactaaaataaattaaagccatgggacaaatactacattgtttcagccacacttcaacctgcacctcagttaataatctatgtgttaatatgttcacgtattattttttcaatttgcttcaactcactatcaatgtttatttcttcactttggcctccttgccatctcccagcaaatgtcagaacatggtgttttgtaacaacccatctgtccatctcactgacaatggtttttcctttcataaagtacttcaatctgacagcaagtgggtgtatcataagaaggcatttgtaatccataatgtaaactgtttagaatcaagtagtccagttttggtgaaaattgattgcttgaataaacatggaagaaccacaccgtcataatgaggtgatttggccaagcacacaattctccccaggtgtaaccaatctacttttaaaatgttgcaccctctggtgagaccttcagctttatgttcctgatctttgttccatacctggaccttgattactaatgacccattctctcccaggagacccactctctctccctgaacacatatgttcagaggaattgacaatggcctcttcatctgtcaacaaggtggaatcaaaactcatgtttcaaaagacatggcagccagacagtgactccagccctctcatttgacaaatgagtctactgattctaagtgagcctataatgatgtttctgctgaggacaccaccactgacttctacttagtaagctcacacttaatcaattgtacataacctgaatcaaaaagggctgcccagaagaatgtccaagctgggggatggagaatggacagttccaaagctagaacttggcacctcttatcaagcaaagaaaggtaccagagagaagcccgacagcatgactgactgaagcagtgactttcaaagtgtggtactggaaccagtgatatcagcctcacctggaagcttttgcaaattctggtgatataccttacactcgtagaatcaaaactcctggggctggagagcagtcagctgttttacaagttgtccaaatatggctgatccccacgaaagcctgagatgcttactcttcctttgctttatgtgacttcacgaaatacactccaaatgtctcctttctttcttttttttttctttctttcttttttttttgagatggagtctcactctgtcacccaggctggagtgcaacgacgcgatctcagctcactgcaacctccgcctcccgggttcaagtgattctcctgcctcagcctcccaaggagctgggattacaggcgcccaccaccacgcctggctaatttttgtatttttagtagagacggggtttcaccagattggccaggctggtcttgaactcctgacctcaggtgatccacctgcctcggcctcccaaagtgctgggattacaggcatgagccaccgtgtccggcccaaatgtctctcttctctcccttccaagtgtcccaaataaatgactgagacccttattcagctcttacaggtatcttattggattcttgtcattgagaaagaacaaccctctttgtaaagcagtaagttgatctttgcatgtgctggtttctttttctccaagaccaagactcaaggtaacaacattcagggcggtctagacctctctggcctctgctgtcttggcctcatctcagtctctggccattttcatacagaacaactgtagaaacatgtaatttcttgctggggatgactgtgtggcaaaagcacaaagcagactttaaaggcactctcaaatcaccctattatttttcaaaatagatgcttggcagctgcaaagcttgacaggtgcaatatgttatacataacaagtcattcccacaaggcacattactgcctggaatctggcatgttgaccagcagaggttaaggattaatgttaagttatcaagctaattactcacatgcattaagagtaggtggagaggatatgcttccggataacatgagctgggaactattgctattatcactataaccattaaaaaaaaatctaattgaaaaaacgtaccgtgccccagagataaaaactattatttccatgtgcttccctactgaatattttagcaacacattttggaatatgcctggtaagtcctagaagttgttgttttaatggtaaagcaaaacccccatcttgctatacacatgtaaactaggagatgcaggacttagtagttgagcttcatttgtagtagggaacacccaagaaggggaaaaaaaatgactaaaaatacatgttttccccttctaattgactttactaagtgtcagatttttgtcacattgttttcttgtgatatatgctttttcattatgctaatttatgttattcattaaagagtgcagaataattcatcaaactaaaatagagtacctcatagtctattatgccctgacttatattctaacccattcatcatgattctgggttattttaatataaacttcaaaagacagtgtgttttaatgagggatcacttgagaaaacatgattaattaaatgtgatgcaagcgcaaagagcaataaccccaagaaaaaactgctttgcaaaaaaataaaactcattccaagaaaaatgtgttcattgcagaattagaaggatgtctgaaaagtcaggtatgttttcccagtagaatagatgacttggaattaaatgactttttttccttacacaatatttatccaggatttcaaatttcaatttaaaaatctacttaatcttatcctatgcatcatacggaaaggtgaaatatttctcttttttcagagacagggtctctctgtcacctaggctggagtgcagtggctcaatcatagctcactgtagcctcaacatcctgggctcaagcaatccttctgcctcagactcccaagtagcaaggacaagaggtatgcaccaccaagcctggctaattttttctttttcttttttttttttttggtagagatggggtctcactctgatgcccaggctggtctcaaattcccgaactcaagtgatcctcccatctcagcctcccaaagcactgggatgacaggcccaccatggccacccagaatgggaaatctttaagtaacaaaagcacacacgagagatctgcatgtcatgctctactgattgaactagatacttcaaaacaaactggaaagagtctcttaaattaaaaaattaagtttttaaatctcttttggaagtggaggggtctctcagaccagactgtagagcactggggatccagggttacatactattcattttattttagcgatagggtctcaccgtgttgcccaggctagactagaactcctaggctgtgatcgtccctcctcagtctctcaagcggctggggctacaggcatgcaccacactatttttgaatcccaggatcatcagcaccaggcactccctctgggcctaactcaacctgatgacagccagcgcgtctgtagagccaagtaagaggctctgttctgagtaaaatgcatggcatcccagaaaactcaatgaagcagcaccaccgtcaaaatggaggcaaagggcagtcgacggtctgagagagagggcagagacaacagtcttcagaaaggaaaagaagtttacttgcaaagaagtcccaaaaacagaagaccttaggaccagctcaccaacagaaataatgataatgtgaatttaaagaagaagatgcagcataactaagtttgcatgagtctgctcatagataaaaccatccatctacttatatgatcatgctcacatgccacgacacatcttcacaatcagggttgccaaagacgcaaggaaagtgaggttttcgtttaggagagagaaacttaacagaatgctacaaggtctcatttattcagaagatgaaaacttgtcaggctaaccctgtccttttgtggtcatctcagggcccaaaccttctcctctgactgtgaatggggatgtccatgtctcctcataagcgagagagttcacagcatcagttttgattccagaattacttacagcagagatgtaagcataggaagggacagaaccagggtagggcaccagcgatctggatccacagtgcactctggatcaccctgtaacccctcctcttgtggcctcccatctctgagctagtgacacctgacacctcatttgtgtctgtgcaccccagttccctgacacagtcctttgggaatgaaggcacgtgccttggtcatcttggcaacaccagcgcctagcaaagagcctgacacagcacagacccttagtgtttcctgagaacaagaagctaagccatgtcatgactgccaggatgtttgccatagagtggaagcaaaacatatacagatagagacagacacagagatagagacccagagacagagacagatggaatagatatggatatcccgatacaaatattcacatactgctatgtttggagacatcagttttgtcatgactgaaggtgggaggcatggtactggcattgagtagggagaggccagggatgctgtggaaccattaaaatgcaccagacagcccctccactcaacaaagaagaatctgctccaaaacgtccacagtgtcatagttgacaaaccctgaactagaaacgcatgcataatatacacacagacgaatatatggaaattaaattctagccctaatttcatgaggttatgtaaaaaagcaacctccatcttcttttcaaaattgtggagtaataaagtgaactagagtatgcaaatcttgccctattaaaaacaggtttaaaacattgcaaaaatctatggctcctggataatagaaaaatgaaaattacagatggtcgactagtctatatttgtttttctggtgattgtgatacataaccagagaatatattctatccagattttttttaaaaaatttctttgcagctgtgaaggcattagctcataactccggatacaaaaatgtggaaacaacaaaaacaaccaaaagatgttctctactttcttttaaattctggcccaatgggaaaaaaaaaaatacttcccagatgtaggccatttctggaatgatgaccactaggtttggctgtactgctttcaaaatggtacagccaaatgtcaaaatagaaagggagagggaagagggggaaagaaaagagagatcaggagagagcgagaagagagagacaatgcatttctactcaaagatatgatgggctgacctggcacagtggctcacacctgtaatcccagcactttgggaagcccagatgggaggatctcttgtggccagaagttcaagaccagcctgggcaacatagtgagaccctgtctctgttttcaaaaaataaaaactcaagcctaggcaatatagtgagaacttgtctctacaaactgttaaaaaattagccaagcgtggtggtacaggcctgtataccagctacttgaaaggctgaggtggagggatccttgagccagggagtttgaggctgcagtgagccatgattgcaccactgcactccagcctgggtgacagagtgagaccctgtctcaaaacgtaaataaataaaataaataaaaattcaaaatttaaaaaataaatgattaagcaaaagatatgatggcactatccatcaaggatatatgggacacatattttagattttaaaggcaaagttctagttccaaatgacttttctgttttgaggacacagtctcactcttgtcacccaactggagtgcagtggtgccactggagctcattgcagccttgaactcctggactcaagcgattctcccacctcagcctcccaaagcactgggaatacaggcgtgagctaccatgcctggccccaaatagctttagtagcccaaaacatggaaaagaaaatggggaacaaagtgcccaccttcaaacaattaatggtggacaccaccctaggtgacgtctttgtcccttcttgccacagatgaaatttaaaagaagcacagttgtcaaaacatgttcacaacaactggcctcccattttcttctcattctatctgaaaggagtcagtaacttctgcatgaacttggcattcatggcatcaacaggattggtttcaactctaggggccaggcgccaatgctgtggtgtggtttgtaattctgcctttatgtgggtcattcatatggcaggactgttgggcaggaataggtaacctctgatgtctggttgccatagcatctccttacagctacgtggttctctgctccttgttttaggcacaattacgcctctaggtgagcagaactctgtccactgggcagaaatgaccatcaagcgagggataaaacagcagttggcagagacaaaagtatctggccatgaagaagaaaaagtggaaatctcagcgctgcatcagaaattgttggtgcagagttctcagaaaatattcgtatacttccaattgtggggatgattctattatcactattcgttatgattgtaaaggatcttgcaatttgcattctgcgggagtcctatcagttggaaagcaaactaatgaccctgaaatgcaatcctccttggcatactggatttgttataacaacactctggacctgtccagttgatggggtgacacatgtcaatataagctgtgtattctgttaaaaatctctctcccgtattttaggcttacaggttttggtcaactttctttctggtatacacagtataacaaggagtctacatttcagaagagtgtcattacttccaacagtgtaggcatttaaagacaaggactgggatatttgtgtaagtctagatggactgtctcttgcaataatgccctattagagatttaaacaagagttaatcaactttccttgaatgaacccttcaaagaactcaacaggttctttgtcacccaggctggagtacagtggcacaatctcggcttactgcaacctccacctcccaagttccagggattcttctgcctcagcctccctagtagctgggactacaggtgcgcaccaccatgcctggctaatttttgtatttttagtagagatggggttttgccatgttggccaggctggtctcaaactcctaaactcaggcgatctgcccaccttggcctcccaaaatgctgggattacaagcgagagccaccgcacctggcccattatgtgactttttaaatggtaacaacatatctgcgttatctttataagaatcagggtaatgtgaaacacaaaattatatatttttgagctcactaagaaaatattttctgaagtattaacaacttgaaaagcaaaaaaaaaaccttatgaaaataaaaaagttataattcaaaacaaaagggtaaacagaatgtgaattaagagccttgattagttgccggattcttttcaagccttttgatgggtattgtttctcagactcccctgaggagaggttttaaagcttcggggattaaagaaccccaaaacttcacatctttaccatcttgttctcatgtgcagccttgagaattttcaaaattctttttttgaaagatttcctcattgcctaacttttatattttgcagagatgccggaaagaattataaagtgtaaacacacacacacataaccaaaacccaaacaaaaggcaatgaagcaagcatgtcaggcacactgagctcgtggaaatggctgtcacatacatgcaagctacaattaccatgcacaatgactccacacatgtcccaccaacatacacaacagcaacacagccaagaatgaggacaccgcaacttttgttgcaggcagcaaacatcccctgtgatgtcgaggactccagctgcttggaacgcttccccaagaatctcgataaaactctgctatttcattacatgcatggaaaattggataggcctaaaaaaaagcaattgacaaaaacaaaaaaagacattcttcatctgaaaaatatcaatatccatgatcatgagttaaattactatatgtaaggatttaaaagacgattcatggttttaatagtttctttcttcacgtcaacaacttgcagcaattttattaaatgtttgtccttctctccagtagaaaataattctcttggccaggtatggtggctcacacctgtgatctcagtactttgggaggctgatgcaacagaatcactggaggccaggagtttgaaactagcctgatcaacatagcaagaccccatctctggggaaaaacaaaaacaaaaacaaaaaacttaaaaaaaaagtagccaggtacgggggtgtaacacacctgtagtcccagttactcaggaggttgagggaggatttcttgagcctaggagtgcaaagctacagtgagatatgatcatggcactacactctagtctaggtgacagagggagaccttgtgtaaacaacaaacaaaaaatttgtaaagaaagtaattgttttggaggcaagaagcacatctcacatatgctggggcctcacaatctaagatacctgaaagacggttgtgttttgcagattcttattggttagaagaatgaattgggtgggtacgtgcaccaccagtcgggatggtgttgatggactgatatttttcaagccattttctatcacaccagcaacctttcaattgtcctcatctgtgcaactgtggtgcaaaactgcctccagaagccagtgagaaatcccgtcctagttcccttacaactgagtgtctctggatcataatataggtgctgtttcccctctgtcttctctcgctgttaacatactaagaagtggagtcattcagtacaaatatctaggaatgtgacaatgagggcttgagtttctgctatggatccttggttatctcattttcaggccttcagttttcttatctgtaaagaaaaataacattcctgacctcacagagtagttgtgatggtcaaatagatattttatgtgaaacaactgtgtcagctccaaaacactgtaaaatgcaatgctaaatgccttctgtcctgtggctcaggaattccggagagcttctaatttccactaattcagaagctgtgtccaaccgcaagccaagagatagcctccttttcctcccttcttctttcttaggctctttcttagaggtgtggccaaggatctccatagagatcaactgaaaagcattaagagttgaaattcaaccagattagcaagaaccagcaagacacacatccctaagtgttgtggcttgaatgtggcatcatgttacaatgggcatgctcttaacctgccttgcagaacaaagcacttgagctttgtggctatttattccttctctaacaagttcccaaagtctggctgctagctgggaggctgatgctatatcatggccatttaggttatggtccccaacaacagaccacactgttgcaagactctgtatttatacacatgctgttccaagctggaataactcagctagcagttatgagactttccctaaaaagataaacaccctccctcctctgagatctcatacaaaaaactccatctattgggctgaacttgtctgtttacaaacaagtcttagcctagaatagaccctaagttcctcatgtacagaggttttagctcatctttggaattgtaacaatccactgatattagctgaaataaatgcaacttattaaatcagtactttttaaaaaaatacatttctataggtttttggggagcaggtggtatttggttacacaagtaagttctttagtggtgacttgtgagattttggtgcacccatcacccaagcagtatacactgaacccagtgtgtagtcttttatcactcacccccttcccaccctttcccccggagtccccaaagtccattgtatcactcttaggactttgcatcctcatagcttagttcccacttacaagtgagaacatacaatgtttggttttccattcctgagttacttcacttacaataatggtctccaatcccatccaggttgctgcgaataccatcagttcattcctttttatgtctgagtggtactccattatgtgtgtacacacacacacacacacacacacacacacatacacaccacagtttctttatccactcattgattgatgggaatttgggctggttccacatttttgcaattgcgtgtgcaagtatcttttttcatataatgacttatttttctctgggtagatatccagtagtgggattgctggatcaaatggtagttctacttttagttctttaaggaacctccacactgttttactagtttacattcccaccagtggtgtagaagtgttcccttttcactgcatccatgtcaacatctattattttttgattttttgataatggccattcttgcgggagtaaggtggtaccacatcgtggttcgacaaagcaagcaaaaacataaagtgtggaaaggacaccctattcaacaaacggtgctgggataattggcaagccacatgtaggagaatgaaactggatcctcgtctctcatttatataaaaatcaactcaagatggatcaaggacttaaatctaagacctgaaactataaaaattctagaagataacattggaataaccctttgagacactggcttaggcaaagatttcatgaccaaatacccaaaaccaaacacaacaaaaacaaagataaataggtgggacttaattaaactgaagagcttttgcgcggcaaaaagaacagtcagcagagtaaacagacaacccacaaagtgggagaaaatcttcacaacctatacatctgacaaataactaatatccagaatctacaaggaactcaaacaaatcagcaagaagaaaaaacaagcaatcccatcaaaaagtaggctaaggacataaataaacaattctcaaaagaagatatacaactggccaacaaacgtatgaaaaacatgctcaacatcactagtgatcagggaaatgcaaataaatcagtactttttaaagaaagaaacagattcagcacctatgcagacagtgatttacatgaaaacaatctacaaatgctacatttgttcctttctgggcattttttacatattggctaataagtataactatttttatccaaccctctttaccatcagggaaaatgtctcccctcacctctttgaaaccatacacaaattacatttttaaaatatacaaaggattgcaggtcctggaggatgtagcttttttggggtgtagctccactagttgcatgctgagtaaatccaatgttggctgatacctgaactattggggctcccttgccttcttcctagacctgccatgtagtactgtcgttaatgatgtcctctcactccagctactgcccacttaccctacagctatttcaagcttgcctgaacagtgcatattttcacatttcattgaattctcaacaatgagggagcatgatgtgcttacctactaggtccaagaattgaaatctttttactgaagtcatcaggagctagaaactaaattcaagtaacagaaaatcttctgaatctgtttctttatttaaaatgatgtttaaactttgtataccctctcaattttttgaaggatagtaaatgaagtcttagctgagagtgtaaaagctaacttatatttttacttattctacctactagcttgaacaggtcatttctataagaaccgagttgtctgatcagaaaaaacaaaagtgttgaatggaaccacgtgtttctgaagggaggtgtcttagactgggtttcctagaagcagaggttgaaatggggtttctcggacatgaggtaatattggggcggagagaaaagctctcagtagaagagggaagagaggaagcaggagaaggcagagataagacctgtgtggggatgggctctcagccagagccctgcataagcctgatcccatgcgatgcttttgggcatgaattgcattacagagctgattccagcagggggctgacctcctatatcccctgagcagagagccaatcgccatggtctgcgcacatcaagggaggaggatgcatgaccttgcaagcaagatggtgcccatcggccaaaggttattcccttaaaaggaagcagctgtaagctattagcagctgatacaggagccgggggatggtggggtaagaggcaagaggtcaacaactgcatcgactggagaaggaattggtgtatatcacctcttttaaaatatttcagaaaactccccaaaatgacacattttcctaagatgatggtgcaaagagaactaaaatgtcataactattcattttatcaatcagctctggtcatgggggcaacctaatgctaatctaaagcttgaaagagttatggctatctttgattaatgtaaagaggaaaaactaggtcatacttaataaacgccatatgttgatagacaacctgctttcaaaatatggaggccagggtaagttaaatggaaaagttgaaaggtagctgacttcagaaccctaaggctctgtgagcttagatgatgcccagaaattatgttattctatactttacacaaggcactgcaaagagacattttcagttatttctattcctatttcataaataaaaatgccttttgataatatggatatgcttcattaattgctgtcccaaacctctcttccccccaaaatggtatgagagtcaggtttctggacagcaataccaagtaatccattggaacttctccatttctgacttaatacaagcagtaccccctaacactttcataagtctctctaccttaaccccaacattttatactcattcactgaaacatacctggtaggtgagaacatgaaaggtggtgaatttattttgaataaatatgataacctccaaatttatgattacatttttaaaagtgggaacacttgcaccaacaatattacctttttaatttaggtgtccaaatacacacatgtggataaataatattatatacagatatatatatatatacagatatatatatacagatatatatatacagatatacatatatacagatatatatatacagatatatatatacagatatatatatatacagatatatatatacagatatatatacagatatatatatatacagatatatatatacagatatatatatatacagatatatatatacagatatatatatatacagatatatatatacagatatatatatatacagatatatatatttgatatactgcataaagaaataaacaagttagtaagtgtattttctattgttttttaaatgttctattacagtcacaataaggtagagttttaaatcatgttcaaagagaaataccatattaaaaacacaaaaaattgcaatgaatagtataaggtttcttttgggtcaaattcagaacgtgttagaaacgcagccagagagccaataactcagaccaggaaacaccaagaccaaactgcatcgagtcgtggttctcccagcggctctctaaatgcctggccatcctgcaatataactgaaaactcagcacagagcaaagggacacatcgtaggctgggtatgagcaccacaaaatccattcctctgaaatctgtgagcctggggctgatttgtagctgctggggttttgatgcgctaattgtttgtttactttgccttggaggagaggctggccctctaagtggaatgatctcatcaccagcttcattctcctttttgccaaaacaaacagcttccaattactgctaggaagagcctctgatctctaatcagctaccaaagggagcctatcggtggtactttatagggcgaataacgtcccattaaggaagaatctcttaacatcagtacaattctggaaccctagggccaagctgccagcaacctgctattagtcttccagcaggatcccatccactttctccctgggcattctgaaatctggcaaagacacagacacacatacacacacatcccgcctcacttgcccacggactactacttttcctcaaaccctactgttttgagcctccattgagaaaacacaggcagacaaagagcaggtcccaggcctgccaatgctgagattgccaatggcaggtcccaagcctgcccatgcttagggaactgattatgtttagagcttaagactcagctacacctgtgccatcatgggcagacccagaggaggtcagaggagcaggagtgtccaagatgaagcatagggcatgaagtcactctcaaatgcatcaagagtcacctataaagagacagggcttatctcaggcaccacctccctcctttccttcttctttaatcttctagagaagttgagaacataagaggagagatgtttctccctaagtgagcatatgtcagcatcgtaccctttaacattacaggtgaccctatgaggaaccgccactccaaagtaggtttaaactttcccagatggctgaatctttgacatacaaacaaagcaaattaggtcagtttcacagacgtatgaacagtgcagtccactatatgctcacaagaggacctaggcttggggtatgctctgcaatggccatgctgaaattctttgagtttgagttttgtatgtaagagtcaatagcacactgcagtactcactggagagtggacatgtcagctcagaaccaatcctgactcccaccgcaccctcacctctccaggacaggttctcaccgcccattcccccatcacctggcacctcaggccccactggccttctgctccccacctcccatcacatgatccctgcccactatggtccctgcagggaccgggcatgggtgtagggaagatcagggttggccatatgcatgtcatacagtgtcccatggtatggttgtgtctgtccccattccatgctagtagcatgatggtgtgtttggtgggtggccagcacgattctgagacactggaatggcacatccactgaggaggatgcaataaacctgggagctgcccatctgctgggggcaggagcagctggcctatgaaggggaggcacctggctcaatttccagaggacctgtgccaggcaagagtacaatccccgggtgcagcagcaggcaaaagaggggacctggccagcatcatgcctgagcacatgtgtctgagcccaaggccctaggtgcctgtgagacatgagtgttccctgggcacaccccaaagccttgggggagccttctcttcctccttccaccattcccgagtctggcctgttggaccctctggccatttcagggctccctccaggaattaagtgctctgatatttacatgtaaagctggcattgcacaatataaagaagaagagttagcgtcatgctaaaattaaactttaaaattttcttcactgagaacaacatggataggaaatttaaaacaccatgacaagttaacagaagcaagtggcagaagaaaggaaaacgttttatatcttatttcctttaacaaacactttttttcttgctaagaggccccacgtttttattttgcaccagggcctgaaaattaggtagtcagtcctgaagtaaattatccagctaaccaacaaaatcttaaaaatagaaacaaaaccaaaagctagaagccatcctcactattaacccggctaaatcgtcaatgaactgtgtgatgagccaacttttcaagacctctgagttcttccctaatttagtagctgcctcctaggagtgttgtggggattaaaagagtagtacttgtaaaatacccagaagagtggctgctccttagtaatcttccgggtagtgctagctgctgtattaccatcacctgcatcaccccaacatgttttgcatcctgattgcatcttgcagggcaggtgcttctctcccccactgggcatatgaagggttaacattcaggaaggtgatgtgatgcacccaagctacccattcgcgacgctacagagcctgggtgtagagcaggtctgcacagccccaaagcccacttccctgttccatacctcacagacccacagctcctcttcactctgctaaccgcacatatgtattctacttgtgagcctgaaatagctccatgccaaatgacctggacaaagcatcctggagccagatactaatatttcaggaggtgctaacatgcactgtttcttttcgtgaatgaagggcagcattcagtagtgaaatgatggggtttccatcccatcttcctttcttcctttccaggtcagagcagtgttggattactcaggtatccctggtctgcattcccacccccatgcctcagtactgagtcccttgtgtttttgggcgtggttgacagccactttgtgcaggtggggcagaaacagcctgcagacctggaggtgtcaggtgtgcacatctacccactgcttttctgtcttgttgctgaagggctgggcagtggaggacagtggggacaactggggcacagactatgagacgacagcttcctctgcaggccgacgacagcaggtcactgccccagggaatctgtgtcactgcctacaccatgagtgcataggttgcgctctcctgaggcaaggcctgacagctttcataattgagagtccacatacctggcgggcatccaggctggaggccaggcaagcttctcccatccttaaacatggcctgaaaccgtgcaagagaagatggaaacaggcacctgctccagagacagctttatgggtgggctcatttgcaggagttgggggcgggggtgaccctgtaggaaagcaatcttcttaagacttcccgtagcccagtcatgagttgtctgcagactgattgctccaccttccttcctttttttttttttttttttttttttttgagacagtcttgctctgtcacccaggctggagtgcagtggtgtgatctcggctcactgcaaccgctgcctcccgggttcaaggattctcctccctcagcctcctgagtagctgggactacagcatgcaccactacaccaggctaatttttgtattttttgtagagacgggatttcaagttggccaggctggtctcaaactcctgacctcaaatgatctgcccgccttggcctcccaaagtgcagggattagaggcatgagccactgcgcccggcccatcttccttctaattattaaaaaaaaaaaaaaaaaaaaaaaaaaaggaaggcaagcggtggggaacagggaagcttggggttttataaggagaatgtgttgctggcttttcagatcttaaaaacacttaatccctgcaatttagataaatcagataggcattaccaggttagggttaaggctcccagaatggctttgcaattgattacaaacacagcacttattaagtcttaactgagtaatttgcagcttatttcacccccagctaattaaaatgtaatcaggattgtctagcaatgtgcattctgtcagcagtttttcttccaaagagaaatcatgccaaggagaccacaagaaaagcctttcacgggaactggcttcatctaagctggtgctttagccactgaaactgtaaaacaaataaattacagcactgacaattcaagaaaaagaaaaaaaaaaggtactctttctccctgggaataggctgctccgttttgttttgttttctgttgtttcaaacaatagtgtggcatcttaggagagtgactttcagggtaggactcggagggctggaaaccaggtgcctggggatcggccctctcctggctctgtccaggatgtctgggtaatttcaccacaggaggtgagcactgggtcttccattccctgaagacgcagaaggactacagagcgtgcccatttctctgacacccacgagacgctgcttctacgacttagaacaaactcaactgcacactcgcgaacgcgccagcttcaccagccggttcaagatcatccccgagggtaaggggaatcacttccacattccacccttattaatatggcctcctctggcagcttaattcccagggcctctagggggacccccccccccaccccttgacccagctctggcaggaggggcgcccagtttaagagccaagggtttggcttccagttcccgcccagccaggggaacccctccccccagcccccatttctccttttggtccctccagagtttccctgaagcgagaaattgggaacttggaacaggtgggcacctagggatagaggcgagaagaagaaggagagaaggatgagagaagagaaaaataagcggaggatttcagagctcgcacgctcgacagggctggtacaggcagcagctgcactcgctcgcgctgagtccggaacctgctctcgtgcgcccacccgcacccggagcctcgcgcaagtcccgcgggggtccgcgccacagggcagagtcccggcaacccgctggagccaagcgcgcggctcccggagcctcccacacaagcgcgcgcgcacacacacatactccccaccctcaggctgaaagaacctacgttcggggtttgggggacggttcccccgggactcgttgaggagtatccgaatacggccccgccaaatcccctgtccccggcacttcttccctgacgctctacgctagtccagggcaagaccttgaatctttggggttccgaattgaggcgcgcacagccactcgcacccccaacacgcgcatacacgcaccctggaacacgacttggcacaagtaccctggctggggctccaagggtgggcagcgagctctgagccctcagagagtgaaaaccatctttcaaaagagacaaagtgtcggcccgcgggcacctgcggggctggggctcgaggtgaggtccccaggcgcagccggacgcgcctcccagactccctcccagtgccccggagcgcctgggactttgcgggagtcgccgcccgcccggagtctcgcgcactccaattcccgggaaaccgccacatccacacacccactcccagcatccacgactctccctccccagggaaatcgcctttggtttcctgctgggaaggagggagttggggcaagatgtctcgggcttctttttcttttcaggagccgggaagaggctggaaaggagagttccagcaccccgactgtaagatccacgcccaggggaagccaggatcagccggcggcgctggccgagaactttgcgagcccaggctgggaggcgcgcgccccggtgcgcccacgccgcggccgcagccccagaaagaacccgggcgggggcctccccgtacctggaagtgctggaagaaggcggagatgcgagtgatctgcaggctcaggcacctggaggcgcagcgagcgcgctggacgctcccggcagacagcgactcgtccagccgccgcgcagcagccgcgccggggccggccgccaggcagccgctggaggccgccagccagaggcagagggtcaggaccgcgccgggcaccccgggcaccatggctgcgggtcgagggcgagggcgagggcgccgggcgcgggccgaggctccctgctccgcgccggggctgcactgctgaggaccaggcagacgccgcgactgagccggaaagttcaatccttcaactccggccggaccctcctcgccgacctccctcccagctcgccctcgaggggtggggtgagggggacaggaggccgcaccattggctggaaggcgtgtgagtgacaggggggccgggcgcagggcccatgggccggtctcgtcagctgcgagcccgggcgctccgggggagggcgacgccgagcggctttccacgccgcgcaggtctcgaggggcccagctcccacgcaggcgcctctcccgttcgcaccaaccgcttcctgcccctcccaccttccccctccgtccaggtaaacgtcggtgtgagcaggtccaggcctgccaggaggggtgctcccttcagcaggagggaagaggcctcaggacccccaggggcgtcccacctgcctggggattgaccccgcgcccctaagtggcttgctttctccccgacctcccctgggtccaggcttttcccacgctttcacatattcgaatttcctttgcccaggtagtggaaagaagtgaagaaaacaaatggcagtaagacagacggggaggggagcgtggacatttgccctacagtgtcccggagacaaattcctccttctctccctcttgcatttcttccgtccttcccgcatccctccctccctccctcccgcactgttttccctggagacagtctcagtgcatagctaaccacctttaggtccacacgccttgtttcctcaggtgtctgtttttctagtaagccttgcacgccccaaagtgagtgatttattctaaatagacttgcgtcttaatctctttctttccccacgatttgcccgagcctcttgactcaggctttttagctttggaatggctgctccgtcctctcctgtcgtttttgtctagtgttctctcagcacacaaattctccctccccagccaggatcctgccacagaaagacaggaggcattgataagacacaacttgtaacaaagctctacactcccctgagccccatcaggaagtgacagtccccttgcaggtaggagagcccagagaaaaaagacccaggcacactcctattcgaatggacaacaactgactgctgttcctttgctctgacatctccaccctctcctacccaattgcactttcaccttcgaaaacgggatctctataagcacccagctaagcacagtcagggtatctagatgcactcgctctactcaaagctacatcagaaggctggaatcctctttgcacaaagcctatatagttgttttgcaatttcccacccttttccctattcttatacacaggttccactctgcaattttgagatctgcctgttaacaaattgcaatgacagccatctgcagctatcctattatgagtgcttttcaaatacatcatcttacatgtgtatttcttcacatagcttaaatcagaaaggccagtcaaattaattggccttggtgtgtttctcagcgaattagaaaatcagggtcatcttgttcaaaaggttctataggcaaagccagtttcatggacatgcaagctgtacaatggtacagtcgcactcttagaaggcctgttctgccatcaccatcctgaaactcttcacaatgacagtggcctgttaggaactgggccgcggcaggccagggaacattactgcctgagctgtgcctcaggtgagaaatcagtggcagcattagattctgataggagcttcagtcctatagtgaactatgcatgcgagatgtctaggtagcgcactccttatgagaatctaatgtcgatctgagatggagcagtttcatccccaagccatcacttgctacccccaggtccatggaaaaattgtcctccatgaaaccagtccctggtgccaaaaaggttggggccactctttacttgggctggaaacctagtaattttggcataagcttacacgacttcaatgatttgttttaaaattgctcagaattgcaaatggaaatattttttaagtatgttaaacataatattaacgaagagtaaagaagctaactataatgaccccaagcaggcatgtgtataaagccaagtgtcaataaataatgatgtctgaataccgagattgtcttctaaatgttgtcactttcatttgtgaattactaaaaacatttccaaaagctgtaggggatcctttcctagtgtttgtttggagttgttttgttttgttttgagacggagtctcactgtcacccagactggagtgcagtggtgcaatctcggctcactgcaacctccgcctcccgggttcacgccattctcctgcctcagcctcccgagttgctgggactacaggcgcccgccaccacgcccaactaattttttgtatttttagtggagacggggtttcaccgtgttagccaggatggtctcgatctcctgacctcgtgatctgcctgcctcagcctcccaaagtgctgggattacaggcgtgggccaccgtgcctggcctgtttggaattttaaagttaagcaaatatgtggtcttggtgaaggcaaagatattatgtacaccgacattttcttaggtaactttgatttataattttgcatgtcatatcatgaaatgcatattccagaaagtgaaatcacaaggacaagcatgctgagcttttaaaaacagcctttggatgttcacaggggttgccgtttttttttttttttaaaaagcagtgtgtgtgctacttatatgggttccatagcatattcatttctatgaataaatgcgttttgtaataaaccacaaaggagaacagtcagtttaacagaaaacttggttttaaacatatagagccaccttattataaatatgttaaaataatatttgcagttatattgctttcttcctttagaataatcacagacatcctctgtgattacgcaggcctttctcatattatttactttaattgcagcttaaagtaacttttaaaaggaaagcattctagtaaagtcagaataacagtcaaatttcggtgtttttttgttttgttttgttttcattctgcccatgtatgcccaacttattatgcagctcaccttgcaaactgaaacatggaagttctctgacttttgacattaccaggtaagccacaatctaagttcatgaaagccaaccacaggggaggagaaccctaagagtatgctgaggaaatgatggataaaggggtaggaccctcgggtgcagctagtaagacggtacttagtatgtctttctccaaatctccttgacccccatgatccgaatttgtctagagaagaatttaacttcacattgactttggtttgacttaaatagacaaacacacatttaacaaagagagtagaaaagcaccttaattatctcttatttatatctacatgaacaaagatagaccaaaatgtgtggttgtcttggtcaggttctggagaaatcacacaaaataaagccctctttcacagtttccaaaaattattattttccttgtattttaattattggtttttcttttctttctttttttttttcctgtttttctgcagagaatgagaaacacctgaaatctttactaaacatagactccagggccctaaattgagagattctgagtcagtatatccggggtggagggttgaaatgtcagcttttaaataataccccaagtgattctatacaaattcaaccagggactacactttgagggataattgattttaaaagtacatctgaagcccgactcggtggctcatgcctatgatcccagcactttgggaggccaaggcaggaggatcacttgagctcaggagtttgagaccagcccgggcaacacggtgaaaccccatctctacaaaaagtacaaaaattagccaggaatggtggtaggtggtaaacatctgtggtcccagctactcaggaaacctaggtgggaggactgcttgagcccaggaggtcgaggctgcagtgcacccagatcatgccgttgagttccagcctcagtgacagggccagaccctgtctcaaaacaaaaaacaaaacaaacaaataaaaaaaagtacataaccattaaaaatggtacaaaaaattttatttaaatagcatctatgatttactgttgtttaaagtatctttttttagatgtgtgtttatatggattggacatactagtctatttcttaacaatcaaatggacatatttttccagtacatttagctaagactctcttagactcattgtttttttcagaaagcaacttgcctttttaaagggctttcagctacactggataaggataaagtttgaaggtagcaaatataatctttatctgacatgcctctcttggaaaagcaaaatgagaactcactcaaaacttggagaacaaatacttaaatatgacagcatttaggagtcatgaacaaaacgacatcgtccctggttttggttctcaggggaaagtaaagtgaggggaagaaagtcacagatgaggtctagtttcctttctagttgcctccatttgatgatgcaagagtgtgcatcttcccttagaaactgcagttcacttcaggaaaagcaacagtggcaagatgaaggagtgtgccctgcaagctcactggccatgacccatacttccaccctctcaggcaatgttctcaggctttgctagctcagttccgctaaagctcttctttaaccgctttccttctcctccagacttaatttctcttctgcacagcacaggatacaattaataactgaatggataaatgtcagattttcatctttcgcaatatggtttcaggcaggaatgaggtgtacctttatggtactgtacccatctgttcccgatggccaatttaatgattttacaaataacaatgattgcttttggcatagggtctttgaatatacactctagtttacacaaaagaccaccgcatccatttacagtcttctgctttcttttatcaccttgcaaggctagataccctatttggggataactttagcatataacacatttttcaccttcaacgagattataaaaatttagttgcagtccatacagtttaaagcgatcacttttattagtcatcttgatgtttcctaagattttacaaagtttcagaattgtgtttcctattacttttgtgcactaaagactattttaatgacatttaaacttcctttgcaaaatatacgaaaaattgtcaaatactatgatttctaactaccaccacttctcaataatttgtctctttgccctttcatattgtcatgtcatcatcaatcagtgttaaatttgtttgctgcctgtttacacttgtgctgagagtctggactaagaaattgctaaggtatttttcctggctgcaatcgttactaaagttaaaataattagtaaaaaataggccgggtgcggtggctcatgcctgtaatcccagcacttcgggaggccgaggcgggcggatcacgaggtcaggagatcgagacgatcctgggcaacgtggtgaaaccccgtctctactaaaaaaaaaagaaaaattagccagcctcgggaggctgaggcaggggaatcacttgaacctgggaggcgaagactgcagtgagccgagatcgcgccactgcactccagcctggtgacagatcgagactccgtctcaaaataaaataaaataaaaataaataaataaagtatgtcagaggacgtattttcatgtgtcaagagcaattgtctggcgatgggaatggtgatgtgcaatggtgatgttcggctgtgggtgcactttccctcccggagccccaccatgaatcggtctctctagcacatgtgatggcctctgttgattctggtgtcttacacagcagaacagatgctgcacccagcaaggagggtgggtttttgaaacccagtggtttcacaggctgcttgacgcccgtaaaatgaacgcttgccccagtgacaaggcagttagctaattttaccctacttctaacattaccaacactattataagcaaccataaatacttagggctctcatgtcaaattctccgtacaagccgtagatattgaaaaacatacaaatagttagaaatacttaaagtcaaatgtgggaggctattaaaaatataaacaataactattgtatttcaaaaatgtatgacaaaaatgttactggcttgcccctaaaatatttggagaagcataaacaaattaatagaagcatgaatttagtgaagtcttaaatgatataactttaattaaaaatgacatttctcactttcgagtggcctatttttcatgtgaagagcataatgttcttttcagtaaaatttgtacttaaaattttgtaaaatgagacttttttgaagcagtttttttaaacaaagctcaaataaatgatcatgtttattctgaatttcatgtttaaacatgaaaataaatctacaagtgctcttcagaattactgaaactctattctgttgaaagtattaagtgggtttttgttctctgatgttttcaagccttttgaaattgacattgagccacataaataccaagcgatttggagagaagccgctggaaattacaaaagcagctttttaacaggagacagcgccacacgctggccatttaaataaaacgggaaggaaagcacagaaccgtctctgtgagataacctaattttaggacaaagctgtccactctacagcatatatctgactggggtaatcatgccacattttcacttagcactaacttaattacttccagtgtggatttcaatattgcaaggcgttcctgcatctctacagtcacactgacctaaattagggagattagtatagcagtttcaaacaattttttcctaacttttaaacactttccaaatattccctacaaaattaactgacaaaggtggactgtgaattacatctatggaagcatctgtttggaaccactttttttgcagctcctacatggcttgctttttaagattttgtaaaatgtgagaacatatgaataaaatttgacgccagggaaaagaagggcaaaaaaagttgacaggctttatctgctgccttagagaacatgaagaagacccagaaactacctttcaacactcgccagccgctctgcacaagatgagacaacagccaagagatgaacataaacatgtttggaaacctgggggaagccctgcattgctccaagaccaagcgggcagggcctctgaatgtaactaaggcatgaactaactgtttcctcttctgtatccactggagctaataaaaagcatcccctaggaccacaaataaaacaaaacaaagagacatattttatttccaggattttctgtagtggctagcatgaaccaactggagaatattccgctctgagattgaattttgggtgtttcagagtcagagagcaaagctgactcccttctggtctcttctcctcattgtttctgggactctgaatgcccagccctcctcaggcactatgtagcacatcaaaggtcgactttgagttccatggagtgccaaggccaggagttcacttcgccttttgttttcttagcaatctgtgtttcactgggacacagatggacaacagttgaatatcaaacatggtaaatggagcctgggcaacataacaagaccttgtctctgccaaataaataaataaataaataaaataaaataatcagggcaagtggcacacacccctagtcccagagaggctgaagtaagatcgcctgagcctgggaggttgaggctgcagtgagctgtgattgcaccactgcactccatgctgggtaacaaagtgagaccctgttttctaaaataataagaaaacagaaaagaaaaaaagatggtgaatgggattcacttgatgtttaaatggcgattcctaatgggaatgtttcttcctggtctttctggacattgcctgagatagctaaggtagttagcaacatggtaacaacttctgtgctcaaaaagaaactgaaggggaggtgtccatatgtattcaacacttttctttttcctctcctgcaaataattagtagctaccattctgaattgatgagagttcaggtggtatttatccctgaggaatttatttccagcatctcaatgttcataatgcttttcatatatggaggaggacggtgctaggaaaagcattcagttgagagcattcatacaggcagaaatgctcctgaattactgatacagaggaagccagtgaagaccagtggcgtgattggagaaatggtcagctcatttatattagtaggatgtcgcccagtgaattactgcttcctggcattatgcacaaagaaagaaatgaaaagagatctaaacccttttctgttttcagaagattaggtgcacatgttcattgtttatttaaaatcaaaagactttttatcattgtctgcaaaaactttaaagttatgactatcataactgcctactcagacattaagggattataagacatcatagatagatagatagatagatagatagatagatagatagatagatagataatttagatagatacaattttgtatgtatatatacacaaaatttccataagtacaaggactatttgtagactctatttttctttgtcagtttgtacattttaattctaattatataatttaaattttacaagccttattatttttgttttatacactcaatattcattatgatttaatatttatttatcctttacattgcttcttctttcttatatttccatgtttccatctgggatcattccttctgctggaagaagttaaatatatgcaactgtatatatatattagtatggttctattggaaacagattttctcagatttccttttttttttttttttttttgagatggagtttcgctctttttgcccaggctggagtgcaatggtgcgatctcggctcaccgcaacctccgcctcctgggttcaagtgattcttctgcctcagcctcccaagtagctgggattacaggcatgcgccaccacgtccggctaattttgtgttttttagtagagaaagggtttctccatgttggccaggctggtcttgaactcccgacttcaggtgatttgcccgcctcggcctcccaaagtgctgggattacaggcgtgagccaccatgcccggcctcagatttctttttgaggggatgcattgccatgtctttgtttcatttttatttttggagaatactctttctacaacagaattctagattagcagttatatcctgtcctcattatcgttgttcattttttcaaagtagaacacgggtcttttctgtcattttggaccagaagatttcccactcagtggtcttcaagccactcagcagacaagggaattacttcttgctgaggatacaaaaatctccccatctgctttgctcttaccttgttgagcttatggaactgacttattcccaagaccccttcctttgaaactcctgttcctaaacagcacatatccctagatttcccatgtctcttcctcagtttttttccctggagcctctttttacatccttctggattcgtcactgttcttgaaataatctgttccatgtgatagaatcgaagggcaagttggacaaggaggctttgcatgggaaagaagtccatgtggcaggaattgaggacactgttgctctaccttacagagcccagtcagtactggggctctgtcttctctctatgctgtgaaaaccagaatctcgtttgccagtcctgacttggtgtccacttgggtgaggggctctggcccaggtgtgggtcatttatttttgaccggggcccaccacagaccctgagtttccttcccagagatgaagactctgctttgggtcaagcagctatgcaaagaggcggtgtctacgagtggctccttgggggcctttccctagttgctctgcagagctgtaagatttgcatgtgtctctctcaaccacctctgccctgagctttcactacgctacgtaagaccaactccctgttgggcgtttccaagggcgagacacacgcacaatcctgcctcaggaacccagcccccattgcccagtgcaggaagcgtgcctggcctattgcaaaagtacccaagacggtcaattaaataaaagctgctgaaagcatagagcctgcaaaagactgcctgggtatgaaccccagtcgaccctgtggaagcttttagaagtgtggacttggggatattatatatgttctctgtagctcagtgttctcaaatggaaaatgggaaaaacataccaactttgtggtgtcataagtattcactgagttaatatcggtgaacaccaccggaagtgttagctcttatcacgtctttctaaaattaggatatgctattattgttgccctctttaaaaatcatggctggatcccccctgctgatgtgacagttgtttatcatgcagtaagagttgctttataatgtcttccctcctcaaagttcatctttccccagacccatcagtgtcagccacgctacggaagaactaaacagctggcgccttcacgctgtcactccatgcccatgccagtggtggatgttgctctctcccctgaaatggtcgtctctcctcttggcctgccaaccctggtgcactgagaaatgtattattgtccccaccttaggtaactgtattgtcctatgggcagccttttctaacattctcagatgacacctcctgagtattttcttcatgctgttcatttttattatgttcgccacgccttatcaagtctttgtttacatgtccatgtccatctccacttcttatggctgatggctatttctgataggcgctcaacaaattatttgcctggaactggaaatactcgacactcctcaatttgcggcctctttttttcttacaacttcttaattgttgtattcaatatgtaatttttactctaggtgttcagaagtatgatataagaatttacgaatagcataaacgttatctgaaattatggaggcctaaacccaaaattcatcagaccacattctctctgcttcccagaatgtattagtagtttggctgatttaatgctggctgtcctggttacacttgccagcagggggcaccaaagggctaccctgggagaaagccccagaacttgcttccaaagtcagagttgacactggagcctgaagttccctcatagacaagacaccttcgaagacaaagcttaagatggcaataatgaattatcctccagcaaagcctgaagaggaccagcgaagcaaggaaggaaatcctcaaaccattacctgagagacaaatcaggtgtcagatcaaagatgaatttagtattagagagatacttcttaagtaaagcacaaaatgcattaactaaaaaaagatagagaggccgggcgcagtggctcacatctgtaatctcagcactttgggaggccgaggcgggaggattgcctgaggtcaggagttcgagaccagtctggcgaacatggtgaaaccccgtctctactaaaaatacaaaaaaaaaaaaaaaaaaaaaaaaaaaaaaaaaattagccgggcatggtggcgtgtgcctgtaatcccagctatccaggaagctgaggcaggggaattgcttgaaccagggaggtggaggttgtagtgagccgagatcatgccactgcactccagcctggtgacagagcaagactccatcaaaaaaacaaaacaaaacaaaacaaacaaacaaacaaaaaacagagagagagaaaatttcaatccacttggtcatgttaaaattaaggcatattgtttaccaaagacatcttaaagaaagaaaagagactaattacaatgtggtagaaaatgccttcacaatacacaccagacaaagtgttggaataaagaatatggaattaattcctacacatgaaaagaaaagagcacaaacagaacaaaaaaaaaaaagagaaaatcttataaacaggcatggacagaggaagaaacgtgtttctaaaagacatgtttagcatcattggtgattggaaaaaatataaaataagcccacactctctgttattttttactttggcaacaatttaataaaagtctgaccatgctaattcagctgcaatttagaagtctgaccatgctaacttctttgaaagtgtatggctctacagcatcttttatttttaagatattagagatggggtattactattgcccgtgctggtctcaaactcctggattcaagcgatcttcctgtctcagccttctgagtagctgggactacaggcatgaaccgctgcacctggcttcaaagcatctttgatactttgctggtgcgagtatcgattaatgcaatgactctggaaaagagtcggacatcaccaccaaaaaaccaaccacccgcatagatgacgatccctcattttcactcctggtgcaacccaactgaagctaccgcatatatattatcaaagtcttgaccaagcaactttacagcagcacagctcacgttatcaaaatcctgaaaccaataaagtgtccatcgataggacaacagctgcataaactcttgcacattcacatactgaaatattgtacagctgttaaaattaactacagaaatgcatatgttaaacaaaaaccttaacagtatgtgaaaaaaatgccaacagactacacatggtaagatatactatctctttataaagttaaaggtaactagaataaaaaaaatacttattagtagcaaatatatgcaatagggcaggcgccatggctcatgcctgtaatcccagcactttgggaggccaaggtgggtggatcacttgaggtcaggagttcgagaccagcctggccaacatggcaaaaccctgtctacaaaaatagaaaaattagccgggcatggtggcatgcactgtagtaccaactactcaggaggctgaggcaggagaatagcttaaacccaggaggcaaaggttgcagtgagcagagatcgtgccactgcaccccaggctgggtgacagagggagactctgtctcaaaaaaaaaaaaaaaacacaagtatatgcaataaatttatataaaaggggaagaagcgatcatcgtagacatagattataagataatagtgggtaaaacaggaggatttgttgattgtataaggcctagcttttgttagtggcagtgggattttctggtgtccattacgctattaacaatacctaattaaatagttagctaaataagtaaaatgggctatacctggaacaatgttgcaaatgtcacggaccaggagttacaatttatctaactcagtgtacctgaaaattaaaaatataatgaagtcaaaataacagtgccagacactgcatggtcacttaagcagcaacacagggtcctaagcttctgttgcaatattaaatgcatcatttgttaaaagaatgggtcagaaagcaatggtttgtttgtttgtttgttttgtattctttctggatggaaagtcagagaagaataaggcttagtaattgagtgtttttcttaggaataataaggaaccaaaagatagtgttcagatgactgaaaagtgttagccttggggataaaatagccctagacttttgtagagctgtctcaagtacctagtgaaacaatatgtcactgtcagaaaaaatgagaaggtaaagagtccaagacagggaactgacacatgaggagaagatgagaactccgtggtttaaacaacccatgcttgcaatgacactggtcttctttttttattattatttttatttttccataagttattggggtacaggttgtatttggttacatgagtaagttcttcagtggtgattagtgggattttggtgcacccatcacctgagcagtgtacactgcaccatatttgtagtttttttgtctctcgtccccctcccgctcttctccccaagtctccaatctttggcatgggtgcgatgaacagggaacacttctacactgctggtgggaatgtaaactaatacagtcgctatggaaaacagtgtggagattccttaaaaaactaaaagtagaactaccatttgatccagcaatcctgctactggatatctacccagaggaaaagaagtcattattcgaaaaagatgtttgcacacacatgtttatagcagcaccattcacaattgcaaaattgtggaaccaacccaaatcaatcaacaagtagataaagaaactgtgatatatatatgatggaatactatgcagccataaaaagcaatgaattaacagcatttgcagtgccctggatgagattggagactattattctaagtgaagtaactcaggaatggaaaaccaaacattgtgtgttctcactgatatgtgggagctaagctatgaggacgcaaaggcataagaatgaggctggccttctgtggagctcactgtgcctgtctgcagggagggaatgcctttctttatagtttttcactctcctgggagacacggatttcaggatcagcattatatgcataatgttcaaaataaaatgggccaaatgagatcacataggagtaagtgtgggtataaaacagctataaggagatttcagaggattttaaaaggcaccacaagctagaaaaatagttactacaataatatgtctttccttatatctacaggttggtgagctctggaatgtgcagacgggtaatttgggcaaattttaagtaatgcaatattgggaagtaatatgtgggaaatctctctgtgtcagtcatttgaggttttctgctacttttattgaattgtattcttttatctctgttaagactcatttactttccaattacttgggtgagtttcaggagagactcctgttaaatgtgctttttaaatgctattgggagactattcagtaatatgataagtcaacttctgtttatttctaacttcgtaactaattccgggaaagttctgagcacatggtggggagagacggagagagacggagagagacagagagagagagaaagagagaaagagacgggggtggagagagagagagagataatacttgcaccactgtaattaaagtgaagggaagtgaataagaatccaagtaaaaaagcagactgtttaagttcaaaccacagctaattattcttcttttttttttattatactttaagttttagggtacatgtgcacattgtgcaggttagttacatatgtatacatgtgccatgctggtgagctgcacccactaactcgtcatctagcattaggtatatctcccaatgctatccctcccccctccccccaccgctaattattctaaaagcgattttaaaattctcaatccacaggcatttttatgtgctgagttttattgttgttgttgttgttgttctttgtttgtttgttttttgagatgcagtctcgctctgtcatccaggctggagcgcagtggcgtgatctcagctcactgcagcctccgcctcctgggttcaagcgattctcctgcctcagcctcctgagcagctgagattacaggcaggtgctaccacatctggctgatttttgtattttttggtagagatgggatttttccatgttggctaggctggtcttgaactcccagcctcaagtgattcgcctgcctcagcctcctaaagtgctgagattacaagcaccttgctcggcaagtgctggtttctaattacagataaattataatggctttgatttagacttgcaatctcacacactaacagcatgaaatactacataaggtgaactattattattattattattattagcttgcctctctgatgagtcactgaaatattcactataaagaaatggacttagaacttgaaggttgccacaaagttgtcaaaacaaagaaggaaatacttttattatattccaaaactttcttttctgttttttaatgtggatttttctttaagtgaaagaaaatcttcttttataaaatataaacaagtacataggaacttatggagtaatgacagctgttaaattctggtttaagttggagaattgtgtcattttatttgtggatacttttagtgtggataagataaatcaactgtgggtggttttgagttcctgcattattttatttatttatttattttgagacgaagtcttgctctgttgcccaggctggagtgcagtggtgcgatctcggctcactgcaagctccgtctcccgggttcacgccattctcctgcctcagcctcccgagtagctgggactataggtgcccgccacactaattagcccgccgggctaattttttgtatttttagtagagacggggtttcactgtgttagccaggatggtctcgatctcctgacctcgtgatctgcccacctcggcctcccaaagtgctaggatttcaggcgcgagccaccgcgcccggcctacattatatcatttaaatgggtgctgctcaatgctaaaaactattaggaattttaaaatgcagaggcctaggccctactgcgagacatccacatttaattggtctggggtggctttggtgtcagtattgtttaaagcaccttggtgatttgaatgcctccaggttagagaatcaacaagaagaatacttttccctaaattcaaatagtagatttcagaaaagtcctggtaattggattaaaataatgggaaactcatggtttctcaacatcaaccccattgacgttttagacaggatccctcttcgtcttggagactgtcttctgtgtgggatttttagcaacaaccctggcctttcaccactagatggtagtagaacctcttaccacttacaacaccaactgtgtctccgacattgccaaagggaccccggtggggcaaaatcgccccgctccccaattgagaagcactgacataaccaatcccatgtttttcaaatcatccattagttctaggaaaaccaaccaaataaataaacacatccttcaactaaaacagcattatataacaacacacacacagagacacacacacagacacgaacacgtaacacacacgtatgcacacagatacacacacacaacacaggacacaatattttaaaaaagatgttaaacaacccacagcacagaatgtttcattcaaaacattttgggtgatgtttcgaaggaaaaattaaccaatgtggatgttttccatttcttctactgttccactactccatgccccacccaaaccctgccttcttgcagttcctattcaaatagtctcaatggaacttcttatagagatgaaaacctttctatcttcctttctctaactagagaaaggctggaaatagcacctgcaagagctccctcccaataaactgcaatttactgacagtttatcgtctatcaggtatcaaaggtgtccacaggaagaacaatgagaagcatttattttgcttcatttgtttgctcttattctcctttttctcttgatggtggaagaaaagtaagcttaaatagctttgtttctaatttgatctcccctctcccagtaattttgtgtttcacctctctggcagcaagttcaacattatttattcactcagtaactctctgagcctccttctatgtttcaagtcctggtctagacagggtgatataatagcaggctacataaagtctccaccctcttgaaggttacttattaacagccagagttatctccatcactccacactttatttctgactatgcagtttgcattttctattgcatgagctcttgtttttaacaaacttatgaatgtttgtgactaaaaatgttaagattgcttttcaatgttgaacttgcagtcctcttcttgctctgctgggatcatatgtaaccagcatgccattttgagtgatttgacaaacattcctggcactgtgttgaataagttctaaaataatgaatgttgaacaaggagagggcacctccagtagcccccaaatgggacctcaggtccgaggtcatcattggtcccatcagcagtgggtaatctgagggatgcagctttattccaggttgcctcatcagaatagagcccttgaatggggctatctgcagtggcatgtcacatggctcagtcagctgctgtgatgtatgaattttccaactaagaagcccctgcgagtccataaaataaaacaagtttcatcaacagagtcttgtgcagagctgtgaaaacagccttgagttctccccactccaggttttgcgtggacattgctgaagctgaacatccatggcaacacagtggataccattgggtttcatcttaggcaaaccatcggtgaactaggccctggcacttaggggaaacttggggaaccaaaggccccattcaaccagtgggagtggagcaaataaagtttcccaaaaagaaattactgccaaaatgcaaagcggagatgccctggtgccaggtaagcagccttcttgataattctatttccactggacaactgaggcttattgggccctttcctgtctcgttagtcattgagtcaccattgatgcaccccaaaacagtaatagcaggctggagaacaaggagacctccacagctcaggtgttcagctttgacaagagccctgtagcaagctaagtgctgccttgcaaagggctgtacttgacaggtacattaggggaggcatgaatccacgaccccaggaggcccctgggtggaggctgccttcttctgccagaggctccacttggcaaatcgtcagtcatagagattatagctcaaaagggacgttagtgttgtgggtccctcaaaacactaacaattttgcacctatggttctccatgattggaagtccctgcccctgccccaaacaatcacaggacaagaaacagactacaatgcatcaatttataatacttattcacaagtaaaagcaacataaacagtatgctgaattgcctccgaaaggccccacccacacaagggcattcaacatgccatagggaaccttattcgcccaaatgagctgaacttggatgttcactcaccacatggaaccccgtgggatggtgacttggaagcctgtattcaacaaagccgtaataatttgaatcacttctccgcacaaagttcccagcacaattgcagagatccacatggtactcaattcagcctggcggcagagagaccttagccctagccttcccctctaaagcagctgaggttggctggaggttgagggagggagggaaatgtggggggagagagtgcatctgctcagcacttttatttctgctttcaagtgatctgcagaggcttgcttgtgtgattaaacacgtagtattttttgttttgttttgtttttgttttcctcgtcaattcaatcagctacccctggaagttaagaaatgtgtattagaaatcagcctgacgtttcttacaaattgtagtctgaggccttcacgacagctctgggagatgcttgggtcagctacaatagcctcccatagtttgaaacagatttctttgattttcagagaggtgacaattcctcctgctgtcaatggcatctgctgggcatatagaattcccacttgtagcaacaacagctcacaaaactcatttgaagagactatggccaggcccagcacatgcatgtgcaggtagagatgaccttcctgcttgctctctggccaagagtgactataagacactgttgattatgctgtgagatacacttcaatttcagtgatgttaatatatgtaaacggtaggtgtttcagccagtcacggtggctcaggcctgtaatgccagtgttttcagaagctgaggagggaggatcacttgagcccaggagtttgagaccagcctgggcaacgaagtctctacaaaaaaaaaaaaaaaaaatagaaagattggccgggcatggtggcaggtgcctgtggtctcacatactcacaaaactgatgtgagaagatcatgtcagcacaggaggttgaggctacagtgagctgtgatcacaccactgcacttcagcctgagcaacagagaccctgtctcacaataaataaataaaaaataaataaataaataaaaataggtcttgtgaaataggcagctctagctcacatctcacagcttggttatgagggtgaaacaccccaatccttattctgtgtgcataaacgagggacatggtaacatgcactcagcgtaggtctcttttaaactggtacgtggtttgctttgttctacgggccagctaatttgcctatactcgttctttccatgaagacaaaagagaacattagagaaaagaacccacatttttctcatgtaatgttaaaaccgcattttggatgaagaatggaacaaatagctctgtagagtaaagctaagaaaatgaattaaatggtcaaatgccttcaagatccttaaactgagtctatgatttctactaaggtgctaaaatgctcctcaactctgctgtatccagtcaagatcacgactcccgccataccgaattacaaccaggctgggttttctttctacgttctaaatgtgtgtgaccaatatttatttccagtattacgggatttctaggagatatattaaaagcaattctagagcaatcatctcagattttaaaattacattgactaactgtattgatttttatttttcatgctaaatgactagtctagtaaacatgaaatgtcagtaaaaaagagatttttggttcctaataaagtcataaaaccggtgacataaagatgttggtagattattactagctgggtttctaagactagcacgcacattaacatgacccactaggaatgaataagataaaatgcgtggtgctttttataagattactataatgtgcagcttataactgcaaaatgtgagatctgtctttatagtatttatgaagtgatggcttagaacatgtttagttttttgaccatgaccaatgttgctacattaacaaactgctcttacaacgctattcactatttttgctgccataaattgataggatattttaacaaacaggtgtgtgttttttttttctgtatgttgtattttttaagaataactaaacattgcattatctcttgtaaatatatgctcatattttatgtgctttatttgttttccatttgtcctttcatcgtcatttaaggcaccctttccttccacacttgccctctacactatttgcccatgttggccagcggcagctttttaaattttttatgttttatttttagagatgggatctcgctacatcatccaggatggagttgaactcctgggctcaagtcatcctcccgcctcagcctcccaaaatactggcactgcaggtgcaggccaccatgctctgctgggagtgagcttgtaaagtgcaaaacacacgacggcctgccttgtcctccaccccctcgtgatttcccttccttcagagatgagaaccaacctcttctgcctggcctgctcaaccccttctcatctgcactgcccttcttgggtcttgtctcacccactcctctgcccactccagccccagtggaatttcttactgcactgaagcttatgctttcttcagaagattagcaaatgctcttccctatgccaaagacattttcacaccagtcttcctaggtcctctagtctctgctcaaacatcaccgtctcattcttcaccaagaggaaaacacttctacaacatctaacagaaatagacatagcctttatgagtatcgatgtgcatgtcaaatgggattaaacaatacttaaaatacagtatttaagtagatttttatttatagccctatgtaactaaaaccaaaaatagatcacgtataaaagttatataatagccattgtatagaaataaaatatataagtggatacattacattatcacatatatgtacacctattatatattgatgaaaataattttaaaaataaaatggattatcataagctgagaaaggtgtttatgtgaagaccctctgatttctccatctacatataccctctaccgcatcactcactaaacccttattccccttcatttttcttcctaacgcttccctctccctcaagttgtgttatttatttttacattcacttgcttattttatttacttgcgtgttctgtatctctccaactagaacataagctccatggaggcagggctttgtctaccaaatttgccactattgacacataacaaacattcaataagtctttactgaataatgaatgaattattcatgtttacagatcaaatactattttataataaatgcatcttgttgttgctttgatgtgatttgcccgcttagggcccgactgaaggaagattctacttttcagctgcctgcttctctccttggtggggaatccggggcatcctctcctttctgactttaagtgattctgctctcagtttgcatgcttttctttctgttttgttgcagattttggaacatttctagtctgcttccctttaggatctgcgttcttgttgtttcctctgcctgaaaaacaccggggggtaattttgcacaactaacaccttacagctgttgaaaacttgctccagtgacaccttctaaagcctcccccgacctaaatctttcaacctggaaactgaccctcatcctggacacactggctcttcttgctctggctttacttttccttcctgccatgggactcaacaacaacaacaacaaatgtagaatgaaagtatcattatgtaaaatacaaaaatagcgtaagatattattataagtaatatttaatgcttattgtttattatgtccctgtgagagcacacatctctgtccatatgctactttccttgtatctgccctcactttccctgggctatgccttcaagctctggcctcaggctctcttccaagcaggcatccagctggttgggctaatgggaggcagtggcaggtgtctccgggtgtccgtatcctttgtgtatttccagcatctctggatatgcctgtttgagtttcagcttccaccaggtggtgccaccttgggcttgctagtaacttcctgccacctaggatcctacctctaggggtcttagtagcttccggagtttgatctttcatcacttcctgaattgcgtttcctcttttaaatactcagaatagttttcctggtagatcttgaaagatttttatatttcttctggtttttaagttgtctggaaagtcaggtcagagatagcaaatcaacgcaatgggcattaagttcttgtcccaccacataataaaaccaaataattttgcagctcaataagttcagcagaagtattctcattttataggttttcttcattattagaagagagctagctgcatcatcaatcacctcgtgtggacaagagctataatctgatgtacagcataatagcagttgtatatggcaaagtaatttatcataagcttttaatgatacaaagaggcacattacatttatctctgtgtccttatcattcagttcgatgcctggaatttaacagttacccgataaatgcttatttaatgatgaaaggaatggactgaaagtattaaaacattatacacaggatggctatgtgttacacattacaatataagatagtacaagaatcctggcaacccatgagcacatgaatgaagaaagatatccctggtttgcaacacaaaaatgctaaggatgaaggtgtgcagacagacatgctgtgaatcataagatgggggaatttccagggagttctcaggatacctgggcaggaaaacctgctgtaaccacatctcttagtattggcttctcaacagtgtcttggaacaggcaatggtgattgatgttcaagagagacaaagaagcactcagaactcagacctctgtggggaaggtcattcccatgaggttttgggcctacttcttaaaggccctggtgtttaatggacaaacagtgaaacagatgcaagacgacagagcaggaacagagacaaacttggattattgtgccatcttgcacacaggactacagaacagaagacggaggacacagaagacaaacttggatgattctatcctattgcccaggatataatcaacaggcttgaatgagtagccaagagagccaacattcaataatgacctgtgctccataatttcattagcatacaactccatgtgatcttaaacctgcccattccaaagactggcatcataagttgcttgttgggctaccattgcaagagcttctgctggatcaaagaggacccatgctgtgtagcatgggtttttgaggcacagattccctcctccggcactgatcaactgtttgtaggccaaaaggcgccaccatgcccagcaccaaatgggccacacaggcaaaggttgaccacattctggcccatgtcatggtgggataccctgcaatttcttctggagccagaggagataaccttttaaggagcagctaaaagacatttccccaaccccaccttgggaagacaggctcttggccacttctcttccatctatctctctactttgaggggaatacaggcccttctacatcttgcccctttaggatacagcttcaggcttctgtgtgtctctataaagcagcctggctgtaggttagaggtaggacctcagcagaggggctacccctagctcacagtatctgtcacctggcccccctggttttgtgttgtcaggtgggacttgagccttggggagctggcaccatactgactatacttttgctgtctgtgtaagtcatacactctcagaatccatcttggctcatcacctccttattgaccaaatccattagacagtggcaagcaaagctagcaggggctgccacactgctgcttaggggttgtatggccacttggcttggtttcacctatgcttctgcatcctgctgtgttaactgaccccagtgcctgcaaggatgctctgttgccaggccaacttgggaggacacggttgtacagaacctcctcccagtgatgtagccacaagtcccttttgctgttcctaaatggtttgtaaactttttccacatttctgtaggtcagggttctcctgtaaccgtaataagtccattgccccatgcatgtggcaagtcactgccccgagacaccaggttgcagcagagaaagaggtttaatcatggggctgccaaatgaggagatgagaggaaaccttcaatccatctctccaaggagtttggggctaggggctttaaggattttggagtgggccgaagcatggagatcactgattggtagaagagtgcagggtgaagtcatgggacagggcgatgaagaagctgtgttctcacgctgattgggttcctctgtggggatcttcaaactggttggcctcagctgtttcactggaattcaggatctgctgaagcaattcttaaacagaagcctctgattctaacatcagagatcctttcgataggaacaacggagatgcaaatggtcaggatctagtgctatggggctcgtggttacaaggaagtgggtgcaagtgcagcctgaggattgctgaatgatgactctctttctgtccggaattcttgggaaccctgtgaggatggcttcctgccctgagtagccccagaactcttgtggagcatccactaggaatgtatgaggtaaaggggttgattttattagatcctcatattgctccaggtttatgagtcactacttgtcctcaaatgcagtcaatacaaaggtatttccttaagaaaaaacagtgggctcatcaagtcaacaccacactgtatttcatcaaagagagccttccttacacattgacagcatgtgaacttccccctgactcaaaatacccataaagtcctctgagcaaacccagaagcaggaacacggttaaggaaggtattcagatctctcagtagagtattttcctgtggccctgtaagccctttcctagctatagctttaaaataaataaataaaagccctagctttcttagccaactgtcactctgtcatatgttttcagctgtggcttttgccacaattgaactcaaattcatctttaatgataacatttctatacttttgcaaagtataacccagatgtgatacattgagaataaaaagcagatgttttcttcagagcctgaatatgctcctctcataaaacatatctgttcataaatgtctgaggctagatgatgatttattgtagctgagctttttgtgccccaccaaaagaaagcctagaagcaaaggtgtgggagtttaccagctgtcctgatggaacaagagagaacccattcatgtcttcatcactattttgccaaaggacagtttttctaatcacgctatgttgagtttattgcaaacaaggttgtaatttcctagttcctctcttcaggatcacaagttactaaggaaaaaaagaaatgaaaattttaaaaccctagggagcaactttaccccatctgtaactgcagaatacttggaaagaaaaaaaatgaaggtttattgtacacacgaacgaggctgcaatctgtgaaagttgtgagaatgaagtgggggtgactagtgttaagaaaatcctggcaaacagagccagggaaaaccatggagacggttcacatgcttgtaggtctgataacaaaaactatcacaaaaggctgcaaaaaccacaaccttgcacaaatgtcatcgcaaccttgcagaaaaagtacttctataaggacatctgccaaacaactccctgaccaaactcggactggtgtcacctttgttactgatttttatagccaaagataattatttcaaaacaattatatcattctcatcatttttctgtttaaaaacctttgtcttcttttacctccctgaataggcgtatagtttactatggcatgtgtgtttctattgcaatgccctgttcacaaataaacatcttttcttttggagagactctctgttatttaggttgacaaagtaaaatgtagttttcactattttgacttcatggcatttcctttaagtctcaggctcaccagtgcatgtttatatggaacgaaaaaaaaaaaaactattatttgaacagacagtgccgccataagaatgtgggatttaacgatggtgcattctaacttcttgagggcctgagtttaacattgattccagtgtgctgagattcctttgtctttgggaatgacctgcttgtgttcgggtgggagaatccaagggccactttatagaaacagagattccccaagttcatggagactttaatattaaccagtcctaaatccatagagacagaatccaaagattagtggttgccaggggctgggagaagggaagattggagggtgattactaatgggctttcttttcgaggtgatggagatgttctggaattagatagtggtgatggtgatacttgtacacccttgtgaatatactaaaaactagtgaatagttatactttaaagtggtgaattttggactacgtgcaatatctcaataaaaatgaattaaaaagtcagtactatgtcaaatttcttttgtgtgcatgtgtgcacacaaacgtgtcaccagccagtctacgcattcatatggtaatgctcacatcagcacccttgccatgggattgtccaactttttacaaatacccccaggagagagcaaggcaccacctttcaaagcagccccttccatcttcgaatgactctcgttgttagaaaacaattccactggccagctgaaataggctttgctgtggctttcactcattggcactgatgttataaacttagagcttgagaaaatgactttatgaatctttacgaaaaaggctccttaggaacaacattcctattactcctggatcatctcttctccagattaaataacctcagtgtcatcaaccacacaccctgcaacttggtgttgaatcatatttctcatcactctcctcaaagtgtgtccagttcatccaggttttttcagtagtgtggtgtcttgagctgcaagaagtactcctgaagtcatctgatgcagctcttcaagaagcaaaacccaagtccccaacagctcccctgacattgtggtgaacaccaagaagctataagatcagatgtcttctctcaagtagggctgccagataaaatatagaactctcagtttaatgtgaatttcaggtaaacagtgaaactttttttgtataattgtgtcccagagactgcatgggacacgcttatactaaagaagtatttgttgtgtatctgaaattcacgtttatttgagtacctcgtactttttgggttgactttattttttagtatgggtttggattcacagcaaagttgagcagtaagtacgtaaggttctcaggtacccccttcctcaacaaatccccatgcatactttcaatattccatatcagactggtacatttcttaccattgatgagccaatactgatacaccattataacctgaagtccatagtttacattagggttcacaatgacaaatgtataatgacgagtatccaccatcgtagtatcacacacagaatttgggctgccctgaaaatcgtctgcatgccaccaattaatcctttcctgtccccaacccctgtaaacattaatcatcttactgtcaccatacttttgccttttccataatgtcatctatatagcaggaatcatacaccatgcagccttttcagattggcttttttcttttagcaatatgaatttcaggttccttctgatcatttcatggcttgctagatcatttcttacaattgctgaatggtattccattgtatgaatgtgccacaatttgtttaggcactcgcccattgaaggacatcttagttgcttccaaattttggtaatgatagataaagctgcttaaacatttgcatacaagtttttgtgtggaaataaattttcaaatcatttgggtaattaccaaagagtgcaattgttagatcatatggcacatctatatttagttttgtaagactatgcttagttttgcaacatttggcaaccctattctcaatgagttgcacctcttttgaagaggcaaagaacaagcatttcttcaatgagaaaaggctgtaaaggacatctgaaactcgtgttcactcattcattcattcattcatttgatatttattgagcacagtcatgtgctagaccctggaaatacagacatatgtaatggaaaaaattcatgctgtgaaacaaaccaaagcaacataagaagggcagtaggaaaggctcccaatatgcaagtgacagaacgaagaaaagatggaggaattttccctgcagtggcttcaagagaggctcagagaggtatgaactagcaatgtaacacatttatccaatcaacatcttttacctctcttctacactgggtctgaggacacagctatcgtgaaacaggtgaccctgcccaggatcctacagaaaaacaactaaagcatgtttgtgcaactcagaactacaagctcttcctcatgatttggacaatagaagccttcaaagagcggttctttttcctatattttccttcccttctcttaatggagaattccttcttccaccctaaaaaggaaacacgaccatcagtttcccaaatatgaagagggaaatgcatgtgtgtgttaacagtggttaccacctagtggaattttaagcttttgttaaaggattttccccctaacgattgcaattttctaagttgagtaaacatttagtacttcagttactattgtagtatgtgagattttttgtgtcttgggtccaacgtactagttaggtatttctttataggctttttaagatttacaggtgtacctgatcaaaagtaggtgcaaggatctgagatgttttttactgcataatttattccgtgtgtacccagaggccaagcacttggcaaatgaccaaaagatagaatttaaaaagtcagaatagctcatgcaggaaataagtagctggcagataaagaaaaatgtcaaatttatgctttaatggcaatgtcaattatctagaagggacatttatcagttcaacaagaattgattttcttcactctcagctcctatgaacaagtcttcactttctgaaaggtaggaatgtctgctccagtaattaatttgtttatggtaactagtacattgtgagaatctctataaggcatctttctctggcacttattttatcttgatcctggatggaagataatgataaccaagtgacctgtttgttgactagggcacacttaaaagcaggtatgaatatttgatttaacgtatattagcaggacatcgatgcaagtgttgtgtgagtactgagacaggtaggcaagtggcggggtgaacttcactccttaaaatagtgagctcaagagacgtgaactacctaagctgtctgatttttttccatgtgctcttttaaaatgatatatagcaaaagatatttaactgcttaattagtgaaaatctggcaacaaacgatgtctggttaattcatggaaaatgggaagttagaatatatttcaagatactgtttgaattaggcaaataaagttaattcttgtgttttcataaacacagagtttggagaattgctgtctattcagcatttattatttctttttcttttttcttttcttttttttttgagatggagtttcactcttgttgcccaggctggagtgcaatggtgcaatctcagctcactgcaacctccgccttccagtttccagcgattctcctgcctcagcctcctgagtagctgggactacaggcacctgctaccatgcctggctgatttttgtatttttagtagagatggggtttcaccatattggccaggatggtctcgaactcctgacctcgtgatgcacccacctcggcctcccaaagtgcagggattacaggtgtgagccaccgtgccaggccagcatttattatttcaattatttagtacacatgtattgtgcaccttctgtattgctgggaacacaccaggctccaaaaatataactaggactatgataagatttttactctcaggggtaagagttaagtaaataacagccacaatatggggtttgaaaggtacagaaccactaaaagagaggaaaagggacagaattttgtttgagaacaaacagattccagaagaggtgaagaataaggtgatctttgacacaaagcttaaaagattaagtaggcacttgccatacatagatgaaagaaagtgtagcagacaaagaatagaccagtcatgattattaactatcaactagtcaatttttatcacttaatggctatttattcctggacacaattgatctcagggaggtaatgagtagaatggtagctaccaggggctggaaacagtagcagggatgacccggaaaaagcaatgctggacagtgggcacaaacatacatttaaagagaagaaataagttccagtattaaatagcacagatgagtaactctagttatcctgtatttcaaaatacctagaagagatttgcaatgttctcaacacacacaaaaaaagataaaatttgaggtgataatatcctaactatcctgatttgatccttccatattcatgtatcaaaatatcacatttatcccatacacatttgcaactaatacatatcagtgaaaatcatgaaggtattggtaactaatagctaacattaattcaacatgtaccatgtgtctaaccttctcaccatcattgtttcctctgacactcacagtaaccctctgacacagataccatcatcactgtctgttttacaaataaataagaattgatttcagtgtgctttggatgagcagtgctgagcgagccttgatttgcctggataagaatgcaatgcactgtctggttctggttcaatttcatatctcagagcttatgtactgtgagtgcaataaatcaggtgtgtgcacagagatcagggaagagttaagttcctcctaaggagtgagtagagtattttgtgatttgacttgatcaccttaatttagatatcttcacgaagatatgaacctatcaatccaaaatgaaattttaactaacatcaggcagatgagatggccatttccctccggtgtcaggagaactcctctccaagaggcagagacaagagactctgtttctcctgggtttcagttgctaaaggaaaggacttgccactggtttgtaggcaaacttccttgggagacctctaaattttgttcaatgcgttattgctctaaggatatatttagtgctttgtgactgtacatttcaacattcagctgtcgagtgagacaatattaagagacatgatgctcttgatatcagccattcttcgaagcaggtgtttattatggaacaaaagaaaatatatgcttcaatctagaatttaaaagcactaactacaatttttcaagcatatgtatgtaaataaaagttatttgtcttaccattttcaggagaaaagtgaatctttacacttgttttagtgtgattgatttctggtattcgaacctaaaatttaatggtcacaaaaaaagaataaattaaatgttctctttatgaaaagtaaaataggggctatagcacaggtgatgtgagaaaaatagtcactaaaaaaatagtaaccaagagtgcaccctgaaataatctatggaattggggtgataatgatctgttgatgtaagttcatggagtgtaagaaaggcaccactctggtgggggatatgaatagcagagaacggtatggcaggagaacaggtggtaaatgagaaatctctagaccttcagatcaatttgttgtgaactaaaaacaattctaaaaacaaaagtcatatatatgtgtttgtgcatctatctacacatatatgtatatatgtacacgtagatatacatatatatgtacatgtagatatacatatataagtatgcatacatgtgtatgcatatatacacatatatacacacagagacacacacatatatatatacacacatttatacacacacatgcatatatacacacccctaataacttttaagggcaaagactttcttcccttcagaatatctgccaaagggacttcaagtacacagttacttattcgaggtagtaaggggtggcataaatatcaactgttccacactaagtacattgtgacctaattatcgtccttccactatatagttagataggccagtatgtgtaatggaactctcacatggactgctgcagtgcttattttgcctctgtaactactgaaagaagtctcaaatatgaatcttcttagaaacttgaaacagtacttaggcttatataccaacacatgtgttgggtaaaaggaaaatcctttatgaaaatgcaactttaggaattaaatgctccctataaggacccacttattcctgtataagtgattgcaggcagaaaaacagaatctgaatgaacttgttttttttcttaagcttggaaaatcttgaaaaggtaagaatggtatatagggaccaattaaaatgaaaagcacaaggaaaaatgagaggaagtccctcttctactcccccaatgggagtattgtgttttgaatgattcatgaatggaatttcagaaactcagcaaaaaaatacatttaactgacttactccaaatatattctgaattatatatttactaaataaagcatttggaaatgaatattttgtatgctgttacatataaaaactgcacattacaaaaggaaaggtaggagaattcatcacttaagtttttagatgcatgtatacttaaacttccacatactccacaaatattaaacttgaaaaacaaagcactctacataatttaccttgctatagatgtgaaataattgtaagcgtatataaatgttaacgaaatactttcaatcagtgctaaggggagatatcattgaatggtggaccaaaacaaactacatggcaatttgatgtctttgtggaaataacatacctacaagccagtggctcaacactgatattaatatatcttgcacagttgtcttaatcatttattagtttaactttttcaaaaacacagatgttaaggtgctagtaaaaattttgataaggccatagagtatacctattttttgaagtcatactttgccaagaccagatcagttggggagaccctaacccagtggcgctagaggaattaaagacacacacacacagaaatatagaggtgtgaagtgggaaaccaggggtctcagagtcttcagacttgagagtcctgaacagagatttacccatgtatttattaacagcaaaccagtcattagcatcatttctatagatgttaaattaactaaaagtatcccttatgggaaacgaagagatgggccaaattaaaggaataggttgggctagttaactgcagcaggagcatgtccttaaggcacagattgctcatgctattgtttgtggcttaagaatgcctttaagtggttttctgccctgggcagaccaggtattccttgccctcattcccgtaaacccacaaccttccagcttgggtgttagggccattatgaacatgttacagtgctgcagagattttgtttatggtcagttttggggccagtttatggccagattttgggggtcctgctcccaacaatactttcattggaattgcttcttaaacctactgataaataaagaagaatgcacagataaaataggttttgtcttcttttattagagacaaatgtacttttccatgcccatgctttctacagttttggaactgatacagatccacagtggccaaacctaaaactaaattatttttaatgttgaaatttaattgaccatgtatataactgtgcaattgctgctttctcttagaactgtctagggttcattcaacagattgcagaaacaaggtctaacgtgtggttttgtgtaactgaagttatgcttgtatcatataacataggttaaggttttttcttcaatcatcagaataacagagattgaagagacaactgcataagtgccaactcttgctgcagctgtttcaaaaaaaaaaagaaatttaagtaattgtgataacatttttgcaaataaaatattccagtgcttacatcaatcctgagttactaagattaaatatgcattacttacagtctctgacacagttttactttggaaaacagtgatttcttttttaagttgacttccttcaccaaaaagagttctttcatcatacttttccaagttcttgatactctaaaacaaaatggctaggtcactgacaaaccaccactttacatctctcattttaaacagagtaaattaaatgtcaaaaggaaacaatttttggtgttcaaaggatgctagttatttattacaagtttaaaaactgtaatcaatacatggagctccaaatacccacctaaattttttaatgccagatttcagtgaaatattatagcaggtccaaaggtcaagtactttgcttggaaaaaaatgggttgatgaacatcttaaggtcaaaatggagcaaaggcagaaaaaagctagcagtccgatattatgaaataccacatttgttcatctggtagtcacccatttataatcataaatagtccatttaacatggtttccattgaagggataaaatggcctgtgatattcaagcgacatggctcatatgaggcaatatccaaggtttgttgcctcatgccaaggaaatcaaggacatgaaccgacacaaggagtgagtttaagagtggaagtttaataggaaaaaggaagagaaaacagaatagccctccctcctgcagaaagagaggggcacctgagtgggtcttccagttttgtggtggagtgcatagggttctatagactaacttgaggaggcaatgtctgatttacatagagcccaaagattggttggaccaggtgtgatgttttcatagcacacaaagaaccttgccgccccaccctaatcttttttattgtgcaaatgtgtttgctacttggtggctccatgttgtctgctcccttctgcacacgcgatttgcaaggaaaaggaaagatggggccaccatgttggatatgcctagcccccagatagccttttcctattggcacagctgccattatgcaagctttcagctttcttatctatgtctgcagctcgatcttagaggctggtctttattagaaaagaaaggatttggggactgctttttattaaaagggaaaccttactgaggacttccttaccctgactatctgcctaaataatttctttttaattcctatactatttccccctaaggagtggggaccctaactgctgttgggggtgttggacaatgactctttctggctactttctgctgaaagggggtgctttgtgggcaacagaagctagggctgctcctggggttgatctaagagtcctcagaagaaaggtgtgtcatggttttgtctgcagcaccatttggaatttgattgctgtcagccattccagtgggttttaatactggtttgcatccaccagatattgctgaaacattaatataaaagtaaaactctttttaggataaatagcattaggtttgggtggctagtgtaactttagtgttaaccttggttaaatctttgctgcaattattaatcctttaatgactcccacagaccatctacagcatgtttaactttctaacttgtcctaaacatccctctttttaacagccagttattctctttaggacaagaatttaccatacaagatcctttcttatataaacctccattttattacaacccactttgcatagctagggtgtgacatattaccaaacccgataaaaagtcccagcagactcagagatagtaaaaccttcatgtttactgcttgtcagtagctattatttctgctatatggataatacttaagcgaaatgcaacagcaatggaaactctctgtccaacatttcagttagaaggtgctactatgtatagctctaatgcaaatagtagagtgagtatagcaattcccacaaaggtgccatagtagattatttccatctaaaatttaagttgtcaagatatagaatttccctttttgggggtctatgaagttctttggttttattttcccaaagaaaactccaggttatgggtaccctatttattttcattacctggcaggattttcaggataattgcccagaactagcatattggtccagatttttactttacccatccctttttgtttcttccaagctgtaggagatcactacttggttcacaagagtaagcagggttcatctaaaatgtaggcaaaaacactcagaaacaaccaatgagactaaaattttacaacaaatgtatgataagttttggagcataatttttctctctccaatcctcatttttggtaaaaacaaattatgatagaaccgtattgtttgtagaataaactttagttttatacttcacctgattctgtgcataaagtgcagcaagaataattatctttcccacgggcttttaaattgactttggcggaactctgtttcacaaggaatcttagataagacctcttaaagccaagtccagccatgggtttatatcctcaaatacctgtgagttgggtgatcctttcctcttaaagtcccaagataaactcagagctcctagacctgttataaagtgacattctttattgactgcaggtcaggaaccctgtacagggactgcatagatgactgtatgaggcaagtctatttctttttttccccaaggggcttttataaagaaaatgtattcttaatgcactgatccaaaccatattgccataagttaagaatactcacagtctccgaattttagagaaaccaggcagtgaaaaacaaatatgcttcaaattttgttcaagaagcctaccttacttaattgacaaaagcaatagatatcttaaaggaaaagtttccttgactttgaagaagaaaacaaagattagcaatgtttcaagcaaaaagttaaaaaagattacttcagacttctattagtgtaattcatgcagttcaactactgtttgatattcagaaacatttcagctcctcatgaatcctgtatattttctctattccaatgttacaatcttcaaagcgattagaaacctgcatttgagaacaactgttaaagtcctatagcttgattataaaccatcttttgaaagggaacaaagcaagacagcaattgtctgtgaaagacaaaatttccagggtagttacagttaaaaacacgactgacagagatttggttctttctgttgtttacaataacttcaaccttaattataattgatagtatatatttaaacattagaattttagaaatcccacacaattttgaaacatacactaatattattcactaaaatataacctgaagaagattaaacatcattttggcaatctcacatacgtaaccatgttaaataatcctgttaacctttttttttctggacactttaagggcccttctgaagtctccaaaaagccaggtgtcaggaaagacaattttaaaactgaggtgtgattttgagaagcctcttaagtatgttagaggtttaacttttttttttttaattttttattatactttaagttttacggtacatgtgcacattgtgcaggttagttagaggtttaaaatacttgatgttatgaaatagaattccagattaccataaattatttattttgccaaaatgatgactcataaggcaaaaatctttcattagcctttactattacatgaaaatcctgttcaaagccaaattttacccttgaattagtttattatagttaatcccaatttttagtgaaatctcatagacaattacatctaatcttaaccaatttgaccatgggtgaaatgtttgcaaaccttttataaccgttttgctaaaaggcagactagcatcttaagaccatcttgctgtgcctttatttaaatgctcaatttatgaaaaaaccatgtagtaccattttgaatttagttactgtttatacatgggatttttttgcaagattaatttttgcaatctttcataacttgcttaaatcttcagctttagtttatctaatttaaaacaatcctttatccctaggcaaaatttacatttccatgccttcttataatcatttactaaaagcatacgttactgtctttacacaccttgaaaataaatctatttttagtagtttaaattacatgtcataatgataacttctagtaatttgtaactttaatgtgaaacctggtgagttgttttcattatatactagacacagagaaagtctgacttttttcagtataattaggggtgtggttaattttgtatgtccccaggcctcaccaagttgtaaagcaggcagtttacaaccttgaaacatttatcaaacctagtatgagaattgtatgatttagaccacctatttgcattttgacaacacttgtattttaccaataatccttaggactatttttatttattaaagattaacatcacatgaaataaaaggcattacagattttatttttcctttaaaacatatttaatttaagcacttatttcttaagacaattagagctctttttatagacattacacacaacacatgtatagctacacagacagaagattcaacactttaaagatttttcatttgccgttttcttaattggattactggcttcgggggatgccttggaagaacagggacaggaaagcaggcattcctagggtctgataatcagacacatctgaaggcaaagccagatccccaaaattaagagtgccattttatactggatcctggatcccccaaaggagggaaatgctatgggaaaagatagcacagtgtttctaccatgcatttcattgcaaggcaacccaaagataaacagttctttttgcaatcagcccatcatctgtgggagtctcatttctcaggtcagattggggatgtttttatatcttctgggtggctgagagaatgcctctctgttccaaatgtgcaaatagttaagtagccctccataaccagtattagccatcacataaagtatatttcctgcctagttattacacatcaagtatctctcataatgtgaagtagtttctgatatccccaaaactcaaaatcatcagataacacaatgcaaaacaaaacagagtcctggattttgagagagatctatccacttttaactcctgggatttcataaggaaaatagaggctttcttctaaaatggagtctgtagcacctcctctgttcccaaggagtcccaggctaacagatgttatcctagggcctctcatgtgtattaagagtggcaagaaaatggagaaaaataattcagttgactgagaacaaaataaaacctttttcacccaattgctggcaagatggccgaataggaacagctccagtctgtagctcccagcaagatcaacgcagaaggcaggctatttctgcatttccaactgagggacccagttaatctcattgagactggttggacagtgggtgcagcccacagagggcaagccaaagcaaggtgggtgttgcctcacgtgggaagtgcaaggagtctggggatttcctgttcctagccactggaagccatgagagactgcatgggaggaaggaacagtgcactctggcccagatactgcgcttttcccatggactttgccaccagcaaaccaggagattccctctggtgcctgactcagtgggtcccaccttcatggagcccagcaagctaagatccactggcttgaaagtctcactgctagcacagcagtctgaggtcgacctgagactcctgagcttggtgaggggaggggcattgctgaggcttgagtaggtggttttaccctcacagggtaaacaaagctgccaggaagtttgaacagggtggagcccaccacagctcagcaaggccactgctgcccgaccgcctctctaggcagggcatgtctgaaaaaaaggcaccagcccccgtcagggacttacagataaaacccccatctccctgggacagagcacctgggggaagggatggctatgggcgcagcttcagcagacctaagtgtccctgcctgaccattcttaagagagcagcagatctcccagcactgcattcgagctctgataagggacaagctgcctcctcaaatgggtccctgacccccatgtatcctgactgggagacacctcccagtagggatcaacagacacctcatacaggagagctctggctggcatctggcgggtgcccctctgggacgaagcttccagaggaaggaagaggcagcaatctttgctattctgcagcctctgctggtgacacccaggcaaagagggtctggagtgaacctccagcaaagtccagcagatctgcagcagaggggcctgactgttagaaggaaaactaacaaacagaaagaaatagtagcaacatcaacaaaaaggacgtccactcacagaccccatccgaaggtcaccgacttcaaagaccaaaggtagacaaatccacgaacatggggagaaaccagtgcaaaaaagctgaaaactccaagaaccaaaacacctcttctcctacaaaggatcccaactcctagccaacaagggaacaaaactgggcggaggatgtgtttgatgaattgacagcagtaggcttcagaaggtgggtactaacaaacttctctgagctaaaggagcacgttctaacccaatgcaaggtagctaagaaccttgataaaaggttgcgggaactgctaactagaataaccagtttagagaagaacataaatgacctgatggagctgacaaacacagcaagagaacttagtgatgcatacacaagtaccaatagctgaatcgatcaagcagaagaaaatatatcagagattgaagatcaactcaacgaaataaagcgagaagataagattagagaaaaaaagagtgaaaagaaacaaagcctgcaagaaatataggactatgttaaaagaccaaatctatgtttgattggtgtacctgaaagtgacggggagaatggaaccaagctggaaaacacccttcaggatattacctaggagaactttcctaacctagcaagacaggccaacattcaaattcaggaaatacagagaaaaccacaaagatattcctgaagaagagcaaccctaagacacataattgtcaggttcaccaaagtagaaatgaaggaaaaaaatgctaagggcagccacagagaaaggtcagattactcacaaagggaagcccatcagactaacagcagatctctcggcagaaaccctacaagccagaagagagtgggggccaatattcaacattttaaagaaaagaattttcaacccagaatttcatatccagccaaactaagcttcataagtgaaggagaaataaaatcctttaccgataagaaaatgctgagagattttgtcaccatcagacagacttgtcctacaagagctcctgaaggaagcactaaacattgcaaggaacaaccagtatcagccactgcaaaaacataccaaactgtaaagacctttgacgctatgaagaaactgcatcaactaatggacaaaataaccagctagcatcataatgacaagatcaaattcatacataacaatattaaccttaaatgtaaatgggctaaatgccccaattaaaagacacagactggcaaattggatagacagtcaagacccatcagagtgctgtgttcaggagacccatctcacgagcaaagacacacataggctcaaaatacagggatggaggaagatttaccaaggaaatggaaagcaaaaaaaaaaaagcagaggttgcaatcttagtctctgataaaacagactttaaaccaacaaagatcaaaagagacaaagaaggccattacataatggtaaaggcatcaatccaacaagaagagctaactatcctaaatataaatgcacccaatacaggagcaccgagattcataaaacaagttcttagagacctacaaagagacttagactcccacacaataataatgggaggcgttaacaccccactgtcaatattaggcagatcaacgagatagaaaattaacaacgatatccaggacttgaactcggctctggatcaagtggacctaataggcatctacagaactctcatcccccaaattaacagaacatacactcttctcagcaccacatcgcacttattttaaaattgaccacataattggaagtaaaacactgctcagcgaatgcaaaagaatggaaattataacaaacagtctctcagaccacagtgcaatcaagttaggactcaggattaacaaactcactcaaaactgcacaactacatggaaactgaacaacctgctcctgagtgactactgggtaaatcacgaaatgaaggcagaaataaagatgtccttgaaaccaataagaagaaagacacaacatcccagaatctctgggacacatttaaagcagtgtgtagagggaaatttatagcactaaatgcccacaagagaaagcaggaaagatctaaaattgacaccctaacatcacaatgaaaagaactagagaagcaagagcaaacaaattcaaaagctagcagaagacaagaaataactaagatcagagcagaatcgaaggatatagagactcaaaaaaacccttcaaaaaatcaataaatccaggagctgttttttgaaaagatcaaccaaatagatagaccactagccagactaataaagaagaaaagagagaagaatcaaatagatgcaataaaaaatgataaagggatatcaccaccgatcccacagaaatgcaagctaccatcagagaatactataaacacctctatgcaaataaactagaaaatctagaagaaatagataaattcctggacgcatacaccctcccaagactaaaccaggaaaaagtcaaatccctgaatagaccaataactagttctgaaattgaggcagcaattaatagcctaccatccaaaaaatgtccaggaccagacggattcacaaccgaattctaccagaggtacaaagagaagctgctacccttccttctgaagctattccaaacaatagaaaaagagagaattctccttaactcattttatgaggacagcatcatcctgataccaaaaacctggcagagacacaacaaaaaaagaaaatttcaggccaatattcctgatgaacattgatgtgaaaatcctcaataaaatactggcaaaccgaatccagcagcacatcaaaaagcttatccaccacaatcaagttggcttcatccctgggatgcaaggctggttcaacatacgcaaatcagtaaatgtaatccatcacataaacagaaccaatgataaaaaccacatgaatatctcaatagatgcagaaaaggccttcgacaaaattcaacagcccttcatgcaaaaaactctcaataagctaggcactgatgtaatatatctcaaaataataagagctatttatgacaaacccacagccaatatcatactgaatgggcaaaaactggaagcattccctttgaaaaccggaacgaagcaaggatgccctctcttaccactcctattcaacatagtattggaagttctggccagggcaatcaggcaagagaaagaaataaagggtattcaattaggaaaagagaaagtcaagttctctctgtttgcagatgacatgattgtatatttagaaaaccacatgatctcagcccaaaatctccttaagctgataagcaacttcagcaaagtctcaggatacaaagtcaatgtgcaagaatcacaagcattcctatacaccaataacagagagccaaatcatgaatgaactcccattcacaattgctacaaagagaataaaatacctaagaatacaatttacaagggatgtgaaggtcctcttcagggagaactacaatcaactgctcaaggaaataagagaggacacaaacaaatggaaaaatattccatgctcatggataggaaaaatcaatattgtgaaaatggccatactgcccaaagtaacttatagattcaatgctctcccaatcaagctaccactgactttcttcaaagaaatggaaaaaactactttaaatttcatatggaaccaaaaaagagcccgcatagccaagacaatcctaagcaaaaagaacaaagctggaggcatcatgctacctgacttcaaactatactacaaggctacagtaaccaaaacagtgtagaactggtatcaaaacagatatatagatcaacggaacagaacagaggcctcagaaataacacaacacatctataaccatctcgtgtctgacaaacctgacaaaaacaagaaatgtggaaaggattccctgtttaataaatggtgttgggaaaactggctagccatagccagaaaactgaaactggaccctttccttaagcattatacaaaacttggctcatgatggattaaagactgaaacgtaaaacctaaaactataaaaacccagaagaaaacctaggtaataccattcaggacataaacatgggcaaagacttcatgactaaaacaccaaaaacaatggcaacaaaagccaaaactgacaaatgggatctacctaaactaaagagcttctgctcagcaaaagaaactatcatcagagtgaacaggcaacctacagaatgggagaaaaaagtgggcaaagtatataaacagacacttctcaaatgaagacatctatgctgccaataaacatatgaaaaaaagctcataatcactggtcattagaggaaggcaaataaatcaaaaccacaatgagataccatctcacgccagttaaaatggcaatcattaaaaagtctggaaacaatagatactggcaaggatgcagagaaataggaacacttttacactgttggtgggagcgtaaattagttcaactattgtggaagacagtgtggcgattcctcaaggaaccagaaataccatttgatccagccatcccattactgggtatatacccaaaggattacaaatcattctactataaagacacatgcacacgtatgtttactgcagcactatttacaatagcaaagacttggaactaacccaaatgcccatcaatgatagattggataaagaaaatgtggcacatagacaccatggaatactatgcagccataaaaaggaatgagtttatgtcctttgcaggaacgtggatgaagctggaaacgatcatcctcagcaaactaacacaggaacagacaaccaaacaccacatgttgtcacttataagtgggagttgaacaatgagaacacatggacacagggaggggaacatcacacaccagggcctgtcaggggttggggggaaagggagtgagagcattaggacaaatagctaatacatgcggggcttaaaacctagatgatgggttgataggcgcagcaaaacaccatggcacatgtatacctatgtaacaaaccttcacgttcagcacatgtatcccagatcttaaagtaaaataaataagtaaataaaataaaataaccaaaagagtaaaaaaaaaaaaaaaaaaagaattaatgaaatgcttagccgggcatggccaatggaattagaattagcccagtcttgctataactttctgcttccttattgtcctgagtttcagtgggcaacagattcatctttggagattactacagaaatctctgcaacactgtctttttgcattcataacttaaggctttcataattattgcagaagtttctcagtctctccatgtgaaatttctcttagctattggattttagatatttcacagttccttttgtgcttttaaacacacaggtccaattctgctacttaaagtggttccatgttccattcgcctgctcaaaatatgcctgtttaattcctcttctatggtgattgatctgtttacactatactatactagactggggaagttttaaagttgaatccagctttttagaatgcagacagctgctaaattggtgacaaaaatgagatgctaccttaaaaagtctatccaaatgtaccaaaggtacttgctgtatgaggcatcataacttcctgtgaaaatgaaagctatgcactttttgaattaaaaacaatggtgcacagatatacatacactcctgagcatgcatcaggtgtgccgcacacattcacacacacgcctcctctcccccgcacacacattatcttagagtgtgccttggcatccttcttcacgtagacatacgacattgttgaagagacccagctctgtgtggtcagtctgtgtgcccagcatcacctttgtccctccacagctatgtgcccactttgtgtggtctttatatttttctgaagaagagtcaggttactcattcactttatttgtgtacacacttcaaaaaatatatattataacatttctataatatccaataaaaggatgaaattagaggatgtgacttctgacccaataaaggacaaaataaaatggtaataatcaagctaaaataaaacaaacacaaacaaggtagacagaataaaagtgatatgaacagcaagtatactaacagaaagtacaatataagatgatagaaatgagtccacaaacacaatggatacaaacagattaaactctataatgaaaagataaagacacaaaaggtttgaaaagaagatgatggaaaaccaaacaccaaatatatgttaacccaagtaaaagaggcttaactgtatcaacatcagatgaattaaatattaatgctaaagtcatccttatggataaaacagtcatccatttgagaaaatctgttaagttctcagatagctataacaatttaaatctacatgcatctaattaaatggcattaatatatataatgtacataaaagaaaaattaacagaacaaaaatagaaatgaacaaatccaccattatattggaataattcagcatattctcaccagctgtgagaatggtctatgactggcatagagaccaaaagtaatataaatataaaagatttaatagtttaataagctccttataatggacacatatagaaaactacgccaaataattggagaacacacaatcttttcaagcattccagaaaattttctaaaacttggttacccacttgacataaagtatgtcttctcaaatttcaaagaatctgaaattttctgactctaatacaaaaatttaaaaattaatatcaaaagaaagccttcaatggccctgtatatttaaaaatgtaaaaagacacgtaaagatctctgtgagttaaaagtcataataaaaataaaattgtgtctaggagactttgataataataacaaacttaatttactccattcataattaaggctttcataattattgcacaagtttgacaaagtacatatttaaaagaaaaattttacctttaatttttatgcatggatcttatttgggccataagccaagcacatgaatgtgtgtgtgtgtgtgtgtgcatctgtatatatacaagatattctactctggggcaggcagaaatgtctaggagttgggatgaaatggaattggccatgagttgatgactgcggaagcttggagaaggcctgtagctgtttcttggaccattatctccctctcatccttcaccccaacgagtcctgtatctagtcccatataacaacaccacacactgagacaaatatttttgtcagcttcttacatacacgttgagatgactttatacatttataagaaacaagtaaaggcatatatgtattttcccttgttcacataatatatagtatatcatacacatccatttacaacccacttttttcacctaacatcatatctcagaaagccttccttatcatttgattgtagtggcattcccaccatttggacacacagtgttttattgaatccttcctctcctgaggaacatctagggtgtttgtaactctgtgcgaaggctagggctgccgtgaacaaaactgtgcatccgccacgtcatccatgggcaagtgtctctgcaggaaacattctcaaaaatggaacagctgggagagctgggtcccatatctgatcattaatacattttattactggtggatattaccaaatatttctcctcggggattgtaccaatttgtacttgtaccagaagtgtgcaggagttatttgcaatactttaataacccagtgcatttgcgtcctacctcatcagatgccaccctctgggagatgatttaagagggatgtcttccatgacaatacctcctgggctgcactaggagacagacacgtgcccctaggggtcccgcaaatgcatgtctcataacacttctcacactgcattatgattgccagggttcttcattttctcaagctcctgaataccagttctgtcttatttgtcttctttcacctgtacttcctaccatgccaaacccacaggaagctattggagtgtttgtaacatgaatctttaaaaatgggctgaggtctctatggattatatatacttcctaaatcaatttcaaaatacaaaaaaatacaagcaagaaatagaaagcacatatttttatttatttatttatttatttatttatttatttatttatttattttttgtgagcaacaaggctgtttatttcacctgggtgcaggcgggctgagtccgaaaagacagtcagtgaagggagataggggtggggccgttttataggatttgggtaggtaaaggaaaattacagtcaaagggggttgttatctggcaggcaggggcggaggtcacaaggtgctcagtgggggagcttttgagccaggatgagccaggagaaggaatttcataaagtaatgtcatcagttaaggcaggaacaggccattttcacttcttttgtggtggaatgtcatcagttaaggcaggaaccggccatctggatgtgtacctgcaggtcacaggggatatgatggcttaactcgggctcagcgaaaaagcacatattttaaaaaagcattacagtgtggagattccttgaagaactaaaagtagaactagcatttttttttggttacttttgcattttgttttgtttttaaacatgatacgccgttgtccagggaaggcagagaacagtgaagttattccagccacagagaaagggaatgccagggtgcaagcctctcttgccaaaagccttggagaatctagaagaaatttttggtcgtggagaggcaggaacgtggatcttggggctggacagccttggcccaggttcgggtccttgctctgccatgtactttcccggacctctcagtggggtccctgggccagcagcatcgcatgccctgggagtttgttagagcagagcccactgagtcagatgtgcattttcaactagaccgccaggcgattcttagcatgttaaggtttgaagaacattgacctgggattctgggcaagccaaatcactccagtgtgccttagggtccttatctgtcgcgtggtgataatgcctacttgaaaaggtcgttgtgataattcaatgaggtaaggtagtccagcgctgagcatagtgcctggtccataggaggtgttccatatttatctccagcccgtggaccttctttcgggaagtttaaatttcttttccactctcaaaatggcctcttggttttgaacttgaagctgttgtagtgctgcagtcggacagtagagggcaatctcggtattgccatcgcggagagcgcgacaccaggctgtgtgggtccggactgagagtgcgccggtgctgccggccagcacctgggtacccggccagcacctgggtacccacccagctcgcttacttagcagcaccccttccggggtcgagagtcctgggcctgagcctgcagcctcggccatctggtccctcacttgatctcccactgctagttataaacaaatcttgtgcaaacctcccgggctcatccgcagtcccgcggagcggctagacgttgatgaaggatccctggtcgcctttggccgtctcgggctccaggcagcgccccttcctctgtgtgacgtgaggttctggtggaatttggcatagcagcgcaaccctccaggaagtcttggtgatggtcgcacggttccccttctgctgatgatgtttcgttactgtcactggagagtttaccctggtttttctttcttctttgcagagggcccgccatcaggttttaagtcttcataatcggtccagtcgaacaaggccacgtccagtgtgggtatcacctccccgtcaggcctgcgctgtgcctggggccgcaggggggcgatgagcaggatcagggactcttctgtggcaggtgctgcctcaaaggtggtgaggaagagcatggtgggggccagactggcggaagaatcctccatggtcgcatccagcgccttggcttcggagagctccgccttcatcagggagctgggacctccgaccaaggctcggcctcggtgcagcctcagcctgtccctgcgtctcttgtactccctgctgcgtttcctggctctctaccaccctggacaccgattctccttcttggggtagggaaactcgagccccaggagcaggtccttgacccgcagcaggcctgcaggactctgctcaggcagcggcccctcaggccctggcagcctgtaagcctgcctggtggcggtgagcacagccctatcctgggcctccctgggcaggcctgagccccactccttcttgcccgggccccgctggcggtggtggctggcctgaggcgaccacagcgctgggcctgggaggtcgatgtgattctcgggtagattctgagcaggggtcccaggtgcaagggcgtttgccaggctcagctccaggggcagcaggaggactaggactagggtcggcagggaggaggcggaggggcgccgggccgagcacccgcgggagcctagcgcagcagagggtgagccgcagagcggggactgcggggtggagaggtgcgcgggcggcgggagaatgtcagaactaccatttgatccagcaatcccactactgggtatctacccagaggaaaagaaaggaaaagaagtcattatacgaaaaagatacttgcacaagcatgtttgcagcaacacaattcgcaattgcaaaaacagggaaccaacccaaatgcccatcaatcaacgagtggataaactgatatacatatatatatatgtttcttatatatatgtttcttttatatatgtttcttatatatatatcagtttcttatatatatatgataaaaaaactatgcagtcataaaaaggaatgaattaatggcattcctagtgacctggatgagactggagactattattctaagtgaagtaactcaggaattgaaaaccaaatatcgttatgttctcactcctaagtgggagctaagctatgaggatgcaaaggcataagaatgatgcaatggactttggggactcaggggggaagggtgagaagggggtgagggataaaagactgcaaattggttcagtgtatactgctcaggtgatgggtgcaccagaatctcacaaatcaccactaaagaacttactcatgtgaccaaacaccacctgctcctcaataacccatggaaataaaattaaaataaataaaaagaaatttaaaaaaataaaaaagcattacgaagtcaaattcagtaaaagagacacaaacatggtttaaaatgacccaaaaataacaactttcaaattctgaacacagatagggatggggctatttgtttgttttagtgcctatagaaattgtattataaccaggcttttatagtcatttgttgaaaaaaaagtacaacataaagtgaatacactaatcaaggaagctgtatatatgctataaatatatacatttttcatatatgtccataggggaatgcccatcattctggagaagttgcatggagctgtttagtacattttaaactaattttcctaaaaaaaaaaagagaatttctcctaaattcagacactgcttcattggttaattcattttttaatccatccattcactcaatatctcagcaaatatttatggtggctttttttttttttccttttagtaaaggactatgctaggccaggcacagtggctcattgcttgtaatcgtagcactttgggaggccgaggtgggagaatcacttgagccaggagttggaaaccagcctaggctctgtctctactaagaataatagctaaatttaaaaaatatattttaaaaaaggactatgctagttctttaaggtatccaaagcttatctgacaaaaatcccaggctctgtaaatttatagaagagtgggaaataattttatcagtaaattatatcattgtacttaaaatgttttgatttggctttgattctaagaaatgcaaggaaatataaaatggtttacattaattatatattgcatatattcatatgcaaatatttaaatatgtattaaaatgtatatgtggtatattattcaaccttgtttgtgaatttaggaaaaaagagatttgtacattttaaaacttctttgtatgaaaaaaaattctggaaactgtaagtgcgagctatctacattagtgtttctgtgtttgccaaaacagtattacagcccaaaggggaatggttgaggacagataacttgaccaaatggccctggctaaaaaaggcgaggagattgcatcaaactcactccaaaagcgaatcaaagaataacttgaaactgctgtcactcatttagattttgcttcctggtccttagtggtagctgatgaggtttagaaataagcacatgtatctgtctatactgaagggaagaagataaatctactatggcaccagttccaaacactgcatgagcagtcgagagaaacaatttaccagatcatgcttaatggcaaatcagaaatgacaggtatgaaatgacatgtatgaaaacatcgggctgcaacttgaaaatactggaaaatgagtcatctatgtttacagaaccaatcagatcttggactgataacactttgtaagttgcaattgctggatatcatgtatctatgtgatcaggaccatctgtaatgatgaatggctcatgttcacacagcttcaaatgcctgatttctgaaatgatcaactatttattaggtgtaaggtaagggcaatgatgcatatgatcttctcctgtgcttagagatgttaaaattcacttacggaactacgaacattatgacatgcaataaaacttctaaactatgtagtaacatccaaggcaagattttgtggattatgtgttagtaatgatatttaaagagaatattaacattttgttaagcaaatatattaatatattaattatgtgataattttcattttaaatacaataaattaattttatcgtaagcatcttcttttctatttacacataaaactcctacaaattcacataataaaaactgatgtttttaatctgtactcaagaatagagagtcatatgttttatataaagagagtctatttcaacatggcaaaaccgcttctctactaaaaatacaaaaattacctgggcatggtgatgcgtgcctgtggtcctagctccttgggagtctgagatgggaggatgacttgaggccaggagacagaggttgcagtgatctatgattacaccactgccctccagcctggatgatagagcaagaccctgtctcaaaataaaataaaataaaataaataaaataaaataaaataaaataaataaaataaaataaaataaataaaataaaataaaataaaataaaataaaataaaataaaataaaataaaataaaatacaaagtgtataggtcagctggatacagtggctcatgcctgcaatcccagcactttgggaggctgaggcaggaggatcacttgaggctaggagctcaagaccagcctgggcaacacactgagaccacgtctctacaaaacacacacaaaaaaattagccagcatggtggcacacgcctgtattcccaggtactcgggaggcctgaagtgagaggatcccttgagccatcgcatacaatttgcagccaggtggaagacagtacagacctcaaagcctccattaactcaatgaaccccttccccagcacacggacacatacacaaagacttacactcatggcacttgcttatgggagccagtgtttctccttgggggtagcaaggatgagctttttattgtcactgtgccttctcagtttatgcaagtcaatacctttggacaagggctgagaagaggatggaatccaccctacctccctctttataatggtgccatttaaaaaattattttgtagagatgagatcttgctatgctggccagggtggtctcaaactcctggcctcaagtgattctcccatccctgcctcccaaagcgctgggattacaggcatgagctactgtgcccacctaaaacaatgccatttttaagatgaggtgcatttaaagaaagggtgtatttggtaggcaaaataagtaccctccaaagatgtccaggaactcatccctggaacctgtgaacatgtgagacgacaaggcaagggaggaaatgagttggaaggtgctaatgacaggtaccaatcagctgacctgaaacatggatattatcttgggttaactctgggggagtccagtggaatcccaagggtctttctaagtgtaaaagaggcaggagaaaggaaccagaaagacagccacatgagaaggatccgaccccaaaaatgctggcttttaagatggagaaagaggccatgagacaaggaatggtgggagctttcagagtctgaaaaacacaagaaaacagctcctcccctacaacccccagaagggacactgccccactgccatcttgatttttaacacaaagacactcattctagactttacactgaaactatagaactgcagggcaataagtgtatgtttttatttttaattccaaaaatttcactaacttattttaattgacgaacttaaatggtatatactgtctacaccaggttgctttgaaatatgtgtacatcgtgaaatagctacaccgagctagttgaaatttgcattacttcatctaagtataattttctttgtggtgagaactcttaaaatctaccctcttagcaatccttaaaaatataatactatcattatctgttgtcaccatgttttacaatagagctcttgaacttctcctgtctaactgaaatttgtacgctttggccaacatcttcccagccttccacctcccccagctcctggtaaccatcattctattctctgtttctgtgagttcaactgttctagattccatatagaagtgagataatgcagccaggctcagtggctcatgcctgtaatcccaacaatttgggaggctgaggtggaagtatcacttgaagccaggaatttgagatcggcctgggcaacacagggagacttcatttctaaaaagaatatatattttagctgggcatggtgtgcacacctgtgttatcagacactctgaaggctgaggtgggaggatcgctcgagcccaaaaggtcaagattgcggtgagcaatgatcacaccactgcactctggctgggccagagcgagacaatatctctaaagaaaaaaaaaaaatgtgacttcaagtacacagttgctcactttatagtaaggggtgacataaatatcaattgttccaccactaagtacattttggcctctttctcatccttccactatagaagaaatagtcaggtagcccagtatgtacaacagaacttgcacatggacctccgcagtgcttcttttgcctctgtaactactgaaagagatctcaaaaaaggatcttcttagaaacttgaagtagtacttaggagtacttattagtaccaacacacgctttgggtaaaaggaaaatcctttaagaaaatgcaaactttaggaatgaaatgctccccacagggactcacttattcctgtataagtgattataggcagaaaaacactatctgaatgaacttgctttttttcttaaacttggaaaacctagaaaaaataagagtggtatataggggccaattaaaataaaaagcacaaggaaaaatgagaggaagtcgctcctctccctccaatgggagtattatgttttgaacaattcatgaatggaatttcagaaactcagcaaaagaatacatttaactgacttactccaaatatattctgaatttcatatttactaaatagtttccaaatgaacatttttttacatgctgttacatgtaaaattccttttacatgtaaaaacgtgtacatctttttaacatgtttttacatgcaaaaatatatttttaaacatgttgttacatgttgttatatgttgttacatgtgaaaacattaacattaaaaaaaggaaaggtaggtgaattcatcattcaagtttttagatgcaggtatacttaaacttccacataatccgtgaatattaaactggaaaaacaaagcactctacataatttaacttgccacagatgtgaaataattgtaagcatacataaatgttaacaaaatattttcaatcaatgctaaggggaggtatcattgaatgatggaccaaaacaaactaaatgtcattttgatgtctgtggaaatgacatacccacaaaccagtggctcagcactgatattaatgtatcttgctcagttgccttaattatttatagtagtttaattttttcaagaacacagatgttaaggtatttttaataattttgatatggccatagagtatatctattttttgaagtcctactttcattggaattgcctctttatcctaatgagtaaatacaaaagaatgcatagataggatagcttttgtcattgtcttcttgttttctgagacagagtcttgctcttgtcgcccaggctggagtgcagtggcacaatcttggctcactgcaacctccgactcccgggttcaagtgattctcctgcctcagccccctgagtagctgggactacaggtgcgtgccaccatgcctggctaatttttgtatttttagtaaagatggggtttcaccatgttggccaggctggtctcaaactcctgacctcaagtgatccacccgcctcggcctcccaaagtgctggaattacaggcatgagccaccgcaccgggcaggcttggtgtcttcttttattagagaaaaatgtacttttctatgcccgtgctttctacgtttttgaaactgatacagatccacagaggtgaactgaaatctaaattatctttaatgttaaaatttaattgaccatgtacataactgtgcaatccctgccttctcacagaagtgtctaggattcattcaacagatcatagaaacgaggtctggcatttaacagacaagtgacagaggagctataccgatttatacaacaattatcaaaacactgtcatgtagtttactgtagctcaagttgtgctcgtatcatataacataggttcaagttctttcttcagtcatcagaataacagaggttgaagagacaatgaagtgccaactcttccaaaagctgtttcaaaaaaaaatttaagtaactgtgatacacatttctgcaaataaaatattccagtgcttacatcaatcctgagtttttaaacttaaatatgcactacttacagttctgacacgattctttttaaaaacacggctagttatcaagttcactttcttcactggaagaaatgatgcaataattgtctttagtgtccttggcagcctaaaagaaaaagtctagttcactgacaaaccaccactttacatctcacgttttaaacagggttaatcagatgtcaaaaggaaacagcttttaatattcaaaggatgctggttatttatttcaatttgaaaaaaactgtaaccaatacatggagctccaaatacccacttaaattttttaatgccagatttcagtgaaatattattttagcaggtccaattgtcatgtactttgcttgaataaaatgggttgatgagcatcttaaggtcaagatggagcaaagacagaaaaagtcaggcaggcttaccatgaaatatattttttcagcaggtagtgacccatgtattatcagcaatagtctacggaaagtggtttccattgaagggataaaatggttggtgatatgacctcatcaagttagagaaaaatgtaactatgtttgaaatatatactattccctcaacaaatagttcaacagttcctactcctgaaaatggtgtatgttaatgctaaggaagatgtaaaaaatgtaagcacaatctcttccataatcctgtgacatgagcaaatgcacaaataaaaaaaattaatacaaaaattgtataactgctatggaagggcaactcactcagacatgtagccaaaaatggagacgtatgttgacttagttggcaaaaggtttaaattggtcttagtcaaaaaaaaatttttttaaagcattgtgagggaagagcatgagaaaagcataagagtaacagtgaattccttcagggaaagctgtcaacctggataggcaggagcaaagacagagggcggcaagcctaagagggggtcatgtaaaggggagagtctctgaatatctaagaactgagacggggcatcactgacaggctgggaagagggaagggctaggaagcattttaggaaggggagggttttaggaagataatattgccgatcaatgaaggatggctcagaagagaagagagaactcagaaaagagtttaatagtacaagcaaggaagaatgaggtcttgaactagggcagctgcggtgggaattttaaaaaaagaaatttaagggccattacagaggtaaaacttgcctcatgataactgcatgggaaggataagggacttagaagagtccaagatgatagcaaagttcctaccctaagtggtaacatgtagcattaacattgacaggaaaacttctagtctcatgttcataccaattaataaatggtttctggtgaacattatagcaacattttctctacttgtgacttctatttaaataactgttttgtgtatagatcattctcaagttgcttgaaaattttattttcaaactcttttctcagtttatttaacacatctcagttagtgtagaggagtgacatatgaacatgtcttttcacaaggttattaaaaagaataccttacctcccagaagggaattccattgttacctaaataatgtacatctacatgaagaagaggtcattgatgacaatttgctaatgtgctatacgacagcagataattcacaattcacaacgtgttaataatttgctggctttcccattctgttatacatctgaaccatctcttatgactacaaattgtcatgtaaaaccattactagtcgctgataattttgaaagtgaatatgccataaaacactcctgtattacagcaggaaataaaagagacactcagtagttacacttgcctacttcctatttaactaaaactcttgaaacaacacaagtaaaaaagacatccagaaaggatttatggtcttcctgccttccaccatagatgtgtcattgatgtcctgaaaactgaaaataaaatcttcattaaaacccatttatgcctagtgttccattattggaacgctaagcttgtgggaatcatgtatctcctaccgctcaagaacatagccaaggtctgtttcttcacacacaaaaaatgtgcagcctccggcataaatgtgtcaatgcgttaacaatatacacaagatgtatatttccaggtaaaatttccaatttaccttttcctgttctaaataactcccacaaaactattcacgaatcctaaaaatacatttaccagttatgttaaatttggaacaatacattcaaagtgaaaatggtaagtaatttaaaatgcataaccaaaatgtctttccatacattcggaaacaaacagactttcttctgttatgcacgtgttgtattttataatgtattatgttaccaaatagaacagacctttagtaattgctcaagtagcggcttcatctctctcagcctccagctcctaacacctgtaggttgttgccacctcttctgtttttcttgaaatgctttctagaagcacaaaaaaatagtgatgaaaattgggtaatttttaatacttacaaaacataattctgcattagctttataggaatactctttaaatctatacttcttaacactttcttttaaacaatgtttatgaccaattttaaacaactgtgttcaccacccatatgctaaaatgatataataacctttttcatcagtgattaaggaattttctttcttctacatacataatcaacacatatgtcttaattcttgattttgaatgtagagtatttgacgacccttcctataatttgttgaccacagatgggtaagatatatacagaaattaactaagaaacattctttcttactaagattttaaacaggtaataaatcttggtcatttcagtatgcacacggatgaaccttccaataatgattgcctttctgcaccttgacctaatctccaacaacagtgttctcctctcctctacgtggcactcacttatacagtcatcccctagattttatcattcccaatgactgcaacatctacataatattaataatagcaatgataaagagcaatcatgggtcagatcacatcctgaaaaatttaaataaacccattacacaggaacctttcaatcctccaaataactctgacataagttctcttaccgtgtctccttttgcagataaggaaatttcggcacagagataaataatttgcccatggttcccgagctagcaatcgtcaagctggagttgaattacaagcagtggggctgcagtgtcccagcccttgaccactgcactcagctgtttctccatcttcccaacatacagccactaccttcctgccactgtaggtcactcacttcagtactacagctcaggagtctgttgagacccgacacccactgaatggaacacttttcactgcccattgcccacccccatgtgctcaggtaactcagtcccagctgaaattccacagccagtcatcatatccccatccctgcatctatgccctgcccaactctccttctatcaacgtgcgcagctacaccccaacccaggaaattccaaccctacagctgcttttgcacaaatatgccaaccgggctcactttaacttctttatcgctatgatgctgacctcagttggacccctaatgctgcgtggcaattatattcccctagtacatgagtccacttatgggcccccctctctgggctcatgctctcttccttctttgctggatttctgcatgaactattactacctgagacattgatacaataggttaatcataaagctaagcctgataccaacaatttgttcttcctcttcctcttcttcttcttcctcttcctcttcttctgtttcttctccttctcctcctcctcctccttcttctccttcttctcctcctccttcttcttctccttcttcttcctcctcttctttctcctcctcctcctccttctcttcctcctcttcgtcttctactactattacttctgctgctgctgctgcggcttctgctgctgctgcggcttctgctgctgctgctgcggcttctgcttcttctgcttcatcatctttctgcttctctgcgatgtattctttaaggacattcagcaacttccgagtatgtctataatcacgtttctgcctgtaacacataataagtaatacggtcatatgtcatagagagatgaaaaattaatcctattcaaaccaaaactgacttcacataatttatactataaagtagcaagggagtaatagcagctgaaatcttctttttgggaaaaggtgaaatgagttactgtcattctgaaaggatcccttcctaactgactactagagcagctatcttacattctttatgtgctgaaaacaaaggagagtttactgcactataaatttcccagaaacaataattttctctaacagcagtttacttttcatttcctcaaactaaataacatatgggttctcataagtaggttcaagaatatcatagccattcatcctgtaagatttcccaaaagaaatacttcacttaactctttctccactttggcacaacaatgattttctaaaaggaatagtgaaaacaatttaactaaaatagataacatatttacaacataaggttgtccctttccacataacttaatattgttaaggatctacagactaaacgttgaagacatttatcttatatgcagctgccatatttctagaaatggataaaaattaattttacaggaagactatttttatctggaaggcaaaaagaggtcatcttcattggctttctagataatatgcctcaattctgttaaactgaggttataaaacaaaagaaacttacctgcttagggaacaatcaagtaaaatatgttgctccctagagacgccaatatgtacaggacagtttttgaaattatttgcaccaacaaatacaaagaaatgatataaatatcattatgcaaaaaagccaacaatcatacctttttagttgtttttttttcaaagcacgttcaattgtgttcttggttttcctgtaagctgctttatctatttttatcatttctctttttgcagcaaggccctttttaatgtcagctagatagtaaatgaaaatgcattaaaagttaatgttgaaaagtggtttcttcgcatatattgaaatcaacgtgagatatgatggttcagcaatatcggaaggacatttacattgtaaaatacaaagatcatttcaaaaagcaagatttactcacttgttttctgtaaaaccttttacgtattaatattagtactctaattccaattggtataactgcaaatcacttaatttatggatgatgaaaaaaagcaagtaattttcgattttttaaatgtgcagaaagcgttacaaacacagactctaatttctacatttataaaatgtcctgtaattcaaaggacatgtttccatgaaatactgtcacaattcattatgtaaaacatacagaaaagtatcttatttaataagaccatcaaaagggtagaaataacttagtacacaataagaagagcattttttaagcaatctggtgattgatgctattaactgtattttaataaaagaagcatcgtccatgggtataaaaatttaggcttaagtaaagaaatacattcaaaaacacttttgaaatattttcttggagctttttatatgacatttttatccacagtgctgtgtttcagaaaactgtcctactgcaaggaatgctttcctaaacatggtttcacatcagagatctaccatcaattgctaaaaatagttttcagcaatcataaaagatctgcaccataatacaaatattttttacattctccatctataatgctcagttaggtagctcacaaaaccagcacttactcaccaagcagagcaaagctttccaaatatactgcttgtatgaattatcgctagagaagagctgaaaactgaattgagcgttttaaaaataagagtattgtctccgccgtctctacagaaattttctcaatttttttttgaaaatatggtcctataacagtcagtgcaactaacagttcacatggcaatacaaaatttatgagtttttggatccaattacatgtttctcactgggtagaaaacttgtctttccttttctagtacacagtttattactggaataataatagaatatcatcattttagataattcaattttctcttgtactttaaagaaaacaaaatcagaaagctgtgacaatagaatagctaaattaggaacataaaaactcatattaaaaactcttgagtacatacggacaggaagaggggaacaaaagacacctgggcctacttgaggttggagggtaggaggagggtgaggatgaaaaccacccatcaggtgctatgcttataacctgggtgataaataatctgtataccaaacccctgtgacacgcaattatctatataacaaacctgcacatgtaccctcaaacctaaaataaaagataaaaaaacctgatatatatacttaatctgtgtacactaaaaggaaccaatagagctgtttctcctccagtgtcctctaatatcccccaaataattaaatttccatgtgtatgaaagaaaagccatccctctcacttcaccattgttagaagcattctcacattccacatcaacaatccaaaaggtaagtatgaaaatttattaaacgcattacattaaatacatatgttaaatgctatatatgagaagaaggcatgttaagacagtctcgtcgtccactaattcatataacctactataacagttgtatggttgaaaataattttcaaagactacgaatagctcctaaaacatacctgcaatatgttctagcttcatggtatgaatcctgtaaaaaaagttacatcaaaattttatcataatgctacacaaaatgccatgtttgttgggaagatatgtcttatgtgaaatgttccgcatagaatagaatagtgatgacatgaaccaaagctgacttttcctaaaagaccctatccgacaggcaaaagtgacttaaacactttaccccgtgtgttcatctttttcagcaaaaggttctctttccccatgctcatcagttacatcttcctcccttgtttctgtaaaagggtttctttcctcacattcatcacggactggatcctttcctgcattaaaatgtaaaagacaaaccatttttagaggaagacgctgttgtggacatcttttgtagagaaacttattatttgtggacttttttggctctctaccaattaaagctttaaagcagagctatgcatggaatcactgggctccggaccgttttaccgaggcatttttggaagcccttccggttcaagtcctagtaaacaacgctcacaagtcagaccccttggatgtcaggaccgcatccatggagaagagctgctctgcgagcatctgtaaccctgctatgagggggagcctcccacgggaagcctaaggccctcgatcctgctttgaaaacctggggcctcttggcacatgcacaatggactccaaagccacgaaggggccaggggtctcgggctgcccatgtgcctcccgcgcaaagagcagacagaccgtcctcttgggcgtgcaccttcttttctggccccttgggctgtgtttacctgtgtgcttcttcgccggggcggccctaacttgagcttccaactgagctttggcagccttcctgctgcgcttcctgcccacgggctccatggttggctgtcctgggaagttagaggcgatccctgaacctggttgagtgcaaagtcaaactaagtaagctaaggaaacaggatatgtgaaaggagagccaacgggatctcggattcaagaaagggtggggctggcccaccccgtgtatcctgtgggagcaggaggggatggagaagatgccagtgtcccctcctatccttcctggcccgtccagcccctccctggggctggctgcagaactcacagctgcctcgcacacctgaatggcccctgcaggatccttgcggtgtccctgggacagagctcagccctgcccctgtgtgccccagagacctgcgtggcccggaggaccacgggtgccacaggacctccccagccatctctgggagaatgtcaggggctgcactgccacttgcctgcctggatgcccaggtgacccctcgtgaccccaggtgtcctgtcctgaccggcggccgggctggagggacccactcgaactgtcccccacaacacccctgcttgtcgcctccccacacactccgcccctcctcctccccttcccccatcccctcaccccacgaaccccacacccctcccctcccctgcccccatccctggccccacacccggcccctgcctatctgccactcccccgaccctcccccctctgccaccacccctcccttgctcccctctccaccacctccattcccccaagcccccctcccctgccccacccctccccactgcacacatccacaagtccccgggacaatcccgggccctggggatcactcaggtgtctccagctccctccctgccctggcccatcccagcccaccctcagggcctcgccctgacccaggccccaggcaacgatgccagggccatttcctgctttgaaaacctggggcctcttagcacgtgcatggtggactccaaagccacaaaggggccaggggtctcgggctgcccatgtgccccccgcgcagagagcaaacagaccatctccttgggcgtgcaccttctttcgtggccccctgggcggccgtaacttgagcttccaactgagctttggcagccttcctgctgcgcttcctgcccacgggctccatggttggctgtcctgggaagttagaggcgatccctgaacctggttgagtgcaaagtcaaactaagtaagctaaggaaacaggatatgtgaaaggagagccaacgggatctcggattcaagaaagggtggggctggcccaccccgtgtatcctgtgggagcaggaggggtcggagaagatgccagtgtcccctcctatccttcgtggcccgtccagcccgtccctggggctggctgcagaactcacagctgcctcgcacacctgaatggcccctgcaggatccttgcggtgtccctgggacagagttcagccctgcccctgtgtgccccagagacctgcgtggcccggaggaccacgggtgtcacaggacctccccagccatctctgggggaatgtcaggggctgcactgccacttgcctgcctggatgcccaggtgacccctcgtgaccccaagtgtcctgtcctgacgggcggccgggctggagggacccactcgaactgtcccccacaacacccctgcttgtcgcctccccacacactccgcccctcctcctccccttcccccatcccctcaccccacgaaccccacacccctcccctcccctgcccccatccctggccccacacccggcccctgcctgtctgccacttccccgaccctccaccctctgccaccacccctcccttgctcccctctccaccccctccattcccccaagcccccctcccctgccccacccctacccactgcacacatgcacaagtcccggggacactcctgggccctggggatcactcaggtgtctccagctccctccctgccctggcccatcccagcccaccctcagggcctcgccctgacccaggccccaggcaacgatgccagggccatttcctgctttgaaaacctggggcctcttagcacgtgcatggtggactccaaagccaagaaggggccaggggtctcgggctgcccgtgtgcaggtcagccggccgctcagcgcttcacaccctggttgcgagagggcagcatgctcgacttcctgcctccctaccgcgagcgcttcacctgcgcttcacaccctggttgcgagagggccgcatgctcgacttcctgcctccccaccgcgagcgcttcacctgagggacccctgatgccgcttcctcacagaacctgcaggcactggcaccacgacgctctcttagaaaaatgggtcctcagttctcgcgagagcagctgccctggctatccacgctcctctctgattggtcagctaagtgcgcatgcgcatgcgggtgaaggaccttgggggccacgacccctgctgacacgccttccctctttccgtaagggaccacccatatttgctgtggactggggtgggtggtggttctttggggcctctgtccccagaagttttcagcgcctcctcctggggagggatgcaaggactcgggatggaagccaagtggacggggcctaggacctcgcccccgagctccttccagccacccctgcccctttggctagaatggccttcgccttgcaggtggagcccaggctccctcccatgccctgtgtgtttccaccatgtccagctgcaccctttttatcaatggattgtgcttttatgttttttgcttgcttgtttgtttgttttggagacggagtctctctctgtcgcccaggctggagtgcagtggcaagatcttggctcactgcaacctccacctctcgggttcaagcgattctcccacctcagcctcccaaggagctgggattacaggtgcgtgccaccattctcggctaatttttgtatttttagtagagacggggtttcgtcatgttggccaggctggtctcgaagtcctgacatcaaagtgatccacctgcctcagcctcccaaagtgctgggattacaggcatgagccactgagcccatacccaaagtcgtgtctttaaaggcatcaactgtatgatgtatagttgtttccaagaaatgatgactaaaaggtactgattgagaaacttttgtcatttctttcttcaaaaaaagtcaactagtttcctgctagttcttgccacttaagttagccatagaaatcccaggagtgaccatcaggttgtcaaaggcctttcttcttgttgctgtaaggttgacctgctgatagtaacagatacaccccactctcggttatttcaggatcaagtagatccattggccatggagtgatggtcttttcaagtcaggctattttgagaggtaataaaatattcgtgtactttaatttatttccttttgtacttgcttgttttaaaatacagttctgcacataaatatttttgacaagatgaacaatatagatctattttgtcacattacaaaacaaacaaattattaagataagtcaacaatgactgtaagtagaacattgtatttcgttattaattttcattagatttccaaaacatttttctgtataacatattcagatattttgaattcagcaatgcagtcagatgtttcatgtaagtggctgggtgcagtggctcatgcctgtaatctcagcaccttgggaggctgagacgggcagatcactggaggccaggagttcgagaccaccctggccaacatggtgaaaccccgtctctaccaaaatcacaaaaaaaactgggtggcaccacgcctgtaatcccagatacttgggtggctgaggcgcgagaatcgtttgaacccaggaggcggaggttgcagtgagccaagatcgcaccatggccctccagcctgggtgacacaaggagactctgtctcaaaataaaataaaataaataaaataagataaaataaaacatataagtgttcttatgtgatgattatctgaattgtttcttttttctttgcttttattctacatgggtattacttcacttgttttaaagagttgtgtgttcataataaaggctcccttttctacatagttggtcttcccttcttccctcaacattttaaaaaaaattctacaaaatctacacaatcaacattcttcctttggatttaagctgaattattaatttcttcccaacattacagtttttcagcagctgggaaatggaaccaaatgatgtttaattctcccagcagtgatgtgaggaaacctgcacagaacattgctgcccagggagctcccccaagcctgacatccagtgtggttttgggagcatgtaggcatggccgactgtctgcatgaccgaaattagtcaccagcccctccagaggtcaagactgatacaggtggcccaaagcccccactataaatcatcagcattaactgtctagcatgactcaaagctccaggtaaacaaacacgttatgatcaggcaggatattccaagggtttagaggttatcccctggaaggctgtcaaagaacagacctttctttggaaagtgcagggtttggacaacacagacctgctgagctaacctactactgcactctcaaagagtggctcattcagctgttattctgagttctctctctctctctctctctctctcttcctaaaaagttcagatccttgtggatggaaaatctgggaaacacagcactcactgtaaacacaccatgcctagaattcggctcctcttcaacaacgcgggcttttgaactgggtcgaagtcactatgccaggatgacatttttttaccttagaatgaattccccccaggtggctcctcatcctccaggtatacaaggctcctggatgacccatggcctccacggggcacaccggagtctgaatcacagctgattttctggattgtccttggactcatcaggatgattccacatcttccaaattctagatatcctgatatcgcaatattttttatccctgtttcttaatgaaagggtaaatggaggtagaggtgtttctcaacaacctgcaacaacacatttttctttcaattattcagtacttaattggaaatcagagcccctttctaatgtatcgataacattgggaattgatgactattgtgtagttgtacttaatctacaccatgctaattgctaacatgggctatggaggcagcagagcgtcagatgacaacatatgcacttctctccccgtctgcccaaagctcctggtaactgtcaaatgagcagaggacaggggaaacaataggaatattttaaaactgtggttttcaggatgggaatgtattactatcatacaacctaattatttccttactttgtctatattgttgtatattacccaagcttcagagctgtcagggcaaacctcaaagatgaggaaccagctggcaggtaaaaagcaaaacaaaaacagcccgttgctcaatgactaggatttttggttcaattacatttccttgccatctaaatagccagatgcaatgacccatagatagagccagtgtagaaaatagttcagcctaacataataatgtctaaaggagttagtaattgttctactcaatttgtttcagccattctattggaattcctattaattggaattgatggtaagtatatggaatgtcatgtagtgaaacaaacaacctatttagagcacaccaagtttcatggacaacaagtaacaaatcactttttaaaaatcaataccaaccaggccaggtgtggtgactcacacctgtaatcctaacactttggaggctgaggtgggaggattgcttgaggccaggagttcaagaccaacctggccaacatagtgagaccgccatatctaaaaaaaaagaaaagaaaagaagaagaaaaaaatgaataacaatgtgtacagtgagatcaaagaacactagctaccatctaaccttggtttaatactcttaaatccttgagaaggctggcatacatggagtctctccaggaagacatttgaggcagaaaactggaataggagcaggcaatgtgtcatttcgtcatctgaaatggggactttattaacttgtctgagtataaagtcaagaaagaaagtatttttcaggactgtttaattaaatgtcattctgtttatcaacacagggaaatctggcagcaatttctaaccatatgggatttttgaaagtatatgagaaacatgtgattatgtgtttagctgagtattatttaaaatgtatgcaaaatcctgagagggcttttaactaagttcctaaaatcatcctctggtgcattctatttgatgtgctgttgcgtgcataaaattgttccaatagaagtaaagcagagcctcgataaaaccaacctggcccgctttaatgacctccttcctgtaattgtaaattccataatcgtttcttttgactgtaggcaacataacaagacaaaacctataattttctaaaggaatagaatcaatacaaaaacaaaggtgtttcatactgcttacagaagataaatgtatcctgcaagctgaatgatggcagatcagcttgtgctcttctaaatcatctaaatatcatcagtgcctttgattacagcctcaggcccagtgcttaaaaaatcaaagttcgctttcaaggaatgtcatttaaaaactgctgatcatctaagccttgggaggtcaaggacactctgatttcctttatacttacaagtttaatttgatgtttgccaaaatagacttaggtataaattttacatcaagatgctaagcagagccccacgcaaaatatttataactgggatttgttaaatataagattatttttatgactgggacattagagatgcatccatcaatgaattaaaaaaataaattttaacaactttctctagcatcaagttgaaactcaagtctcaatagagcaagtttcaggaacaggtgggatttcaggaagtttcaggaacagcagctcagattctcttcttaaagggggattccctcttgacatgaagccggcaactcactctgcatgcagaacatgcaacatatttccatgccggggagagaaggatgtgacgtcattcattcattcactcattcagtcattcccttattcgtctatctaatagctgtcaagactcctagtatgtgttgggcattgtactacatgctaagtatatagaatctcttttctaaactcaaaaagttgtaagtaggtggtagtagtggtcaggttaaaacatttgtgaaaagaagaaattacagtgacaagtgctacaatagatagtaagtgatgtaggatccataaggaagaaggacaaattatctttagtgttgacagggaagattttacaacaggagaaattatctgagattagtttggaaggataaggacaaaaaggtattccagtagaaaatggggacaaaaagtagaaaaatggggcactttagtctgggagtcatcaaaggtggggtatacttggaaagagtaaatcttttgtagaactataagagattccagagtctgtgtgagttatagttttaggagataaagttgaagatatttgggcacaatatcttggggtataagccaagagataatataggttttatttttgcacgtcagtggttctcaatcaggggcaactttgtgccccctccctgggatatttggccaggtctagtttttgctgttacaactggggaggggggcaggctactggcatctggcaggtggagaccagggatccactaagcaccctacactgtacaaagtccctacagcaaagactctgtcccaaatgtcgacagtgctagggtgagcaaccttgctctagataatggagattaactgaaagattttacacatggagagaagtaaaggggtactttctaggaaggtgatgcgacatcttctaggaggtttgccacatcacgatggtcatcacaacgctgggaggcaataagacaaacaatattcgtctgcagggagaaagatcaactaacttcttgagcatctactctgtgctggatattcgatgtgttgtatcaatccccccatgatattggcaactgctactttctgcagcagtggggaccgtcagatgaaacaggatgagactagaggctgggagactagaggctgggataccatatagatcaaaattcactctcacatggaaatagtggaggtctggactgtagcagtgtctgtggaggtggagatctgagagcaaagaggaaggtcaaatcaaaaggaattttttaccaattacatgtgagaagggtttagccaccaaatggaaggtttacagaatgacttcgaggtggctggtttggaagagtgggtagctggagagactgtaaaaggaagtctcagaggacaggtacagggccacccgcacttgtgacctttggggtgcccatgggaggttcagatgtagatgcctggtaagcaaagggaaaaataagtctccagttgtaaagagacctcaaacagatatgtgtttaagagtttgcaacatcacaatggtcatcaaaacactgggtgtcattaagagaaacaatatttgcctgcagggagaaagatcaactaatttattgagcatctactctgtgctggacagtcaatatgttatcatctcagtctccccatgatattggcaaggagactgaatgcagacaggcccaggaaggcgctcaaagtcaggcagccagtcagaggcagagccaagcttggaaccgtgtctcaccaaaaccaatccccatccattcattctttaaataatatttataaagtgaattgctgcgtggagaggagaagccacagaacaggttgagaaagaagaccctgagttaggaaaagaaaaagtgaagaatgatgtcatcaagtccaaaggaaggaagaacttcaagtaatagtttcagttatccattgtaaaaagactcagagtcagaccagaggatgtttctgccataaattgctatccaaatgatatcaagtcatgcacacacacacagagtttatatcagagttagaatgtgtacactgcattagacactgagcatcatcagggtcttgctggagtgccaggggcaaaaaacagaccataatttgtagaaaagtacttagagtttgaggaagtagagccaggaagaacagaaggaaggtagggtggttgctaaagggaaaatattttacagatgaagattcagacttgagcatagatgtaggctgaaggacttgagtggaaacaccaaagtttgagtatgtaggagagagggtctaaatgagagaatgaaggagttggccttggagtggagaagggtccactgttcctctaaaatagtggtcttcaatcttcttgggcccatagactctcttgagaatctcgtgaacgttttagatgtctctccagaaaaacaactgtaaacattctcaaaactgggtatgatcttagggagtgcttgctaaaatctcctaagcttaaaatttaacaggctgtccttgagagtgaagaggtgctattaatgttattataaaggacaacaggctccattgaagcttcaagcaatcccagactggtgaattggaagtggctggagaatgtgatgagctggatttcctctgtgctggcattgattatcaagttatttttattgattattattactaatcaatttataattgatttgatattaatttggtattaataattatcaataataaataatattataatcaataatctataattattgtgattaataatcaataattattattgattattattgactgaatcacagtaagagttcccctgaagttcccctgaaaagaacagtttgcatttgttaggaaagaggtgctctggaaattgatttctttcaaacaattggctcctgtgaaatccttgcaatatccttgtgtaaagccagggttatgtggatgacctctgaaagccattgatgtggaaattcctaatgtagaaaaggtatcagagatgtttctggaaatgtttacacctggaatagcaatttggtatatcccgggggaagtatccagagcgaggaaatcaacaggagcccaaagttttgcattctatttattgagtaaaaatgtatagattgctagccacatgacaagacctgctccaagtgctttatgaacgaatttattaaatcctcatcttaagtctactaggtaggtactgccattatccccattttacagagagggctatagaggcacagtgagatagcagggttgatcttagtttgggtcagagggtagatttggaaccaggctgtctgtttccagagtctggcctcccacttctactctatattgagaaagtttacatattataatatgttcacatattcactcagtcaactcttcttataagcttttaaatatcatacttgtttaatcacatgtattctttagtattgtaaaggtaactatctatcctctgacaaggactgtagatgggaagaaatgcatccaggaatctaattaatcacaccagggccctatggatacatttaggggtatgggaacagtacctcatcactacttataggttttgagagccttcaatgagccacctccgaagcctttttaaagatggctggacgtgcttaggcagagggtccctgatttgtgtgctaaagcgccttcaaatgaaggagtttcaggtgaacagaaattctcaggtgttaaatgctgctacaactctggaaacactgcctactcctgccaggtgaccagaaattcaatcaccttctccgctaactgacctcaaagcaactttacccataatagctaagaataccagccaatacttgctgctgagtatttcttgtgggccaggctacacacacacacacacacacacacacacacacacacacacacacacacgcagatgcagatgcaggtactcagtttgcacagtggtacagtaatgcagggtcacaaaaataagcatgcaagttgaagccatctgaagcaagcttaataatcaatgggaaaattataatttatctgtgggcctttaaaatttttgccaaaatattgtaaattctcatattctaagttataaatacataaggacataaatgcgtaagtatgatcaagtattttgatgggtgcaaggtttccttggggagtgatgaaaatgttctgcttgacgtctttttattatataacttttgctacagagagagcatcttttctatgccttaccagattgtcacattcttttctgcttgattcgccttcgaaattttaccctttgtgctgaaatatcaggatatatttgagagtttctttagcttgagagtttttgccagcattgcttcctctgggacatctcgatccttttccccacagccacctcatttctgttgacaggtttggcctcaccacttttctgtggctgcatacctagagtctctcaaatgatggcaatactcccacagtcagctatttcttcaacgactcctttatgtttgattctagctttaccactcttcatttctttgctttgttagccaaatccctctgttgaaaacctgctttgttaaatgttgtgtgtgtgtttttcatgggagataaggaggcaacacaaccacactctttgctgtctttgcacaaacggatatgtgatcatgatgcacatcgtttttaatgcagtgatgtgtggatggaagagctagcagcaaagtttgtattgtatgcaattcctcacagttaacataacatggtaactgaagcttgaactgtgctgtaaggagactgatgttatttgactaaactggggtaactgaaattcaggagtattagaatcttactaattaaggactgcttctgtgtgtttatgtgtgtatgcaaaatcattgatttatcttgcacattgcaagctctattattaaaactaatttacataagggaaacggaggcacaggttgataaaggacccacagctaacaaggaatggggctgggatttgtgtccaggtggtcagctctggaatccaagtacttaacctctccaacacactgcatttttttttttgagacagattctccctttgtcacccaggctggagtgcggtggtgcaatctcagctcactgcaacctccgcctcccggtttcaagagattctcgtgcctcagcctccggagtagctgggattacaggcgcccactaccacgcccggctaatttttgtatttttagtagagacaagatttcagcgtgttgttcaggctggtctcgaactcctgacctcaagtgatccacctgcgttggcctcccaaagtgctgggattacaggcttgaaccactgtgcctggcccacactgcattcctcagttggcccagtataatttacattttttaatgtaaaaaatctattttcttaaatacttggataataaaatctgtttccccccccccttaatatttcttggagaatggcctggtaagaaactgtgttggacactcagggttaggaacactaaagattagaaaggggagaacaaaagctagatgaggctagttatacagcaaaagtgtgcatgaactagtgtagctgcaacatagctcttcgttttactttgtggcaatttcagcacacacctatatctattgtttttccttccatgggtatctgctgttcagacaccttcaacaaatatttattcagctcttactcgatgccaggttctatgttaatctcctgcctttagaccatgggtcctttccttgttttgcctcagtgtgtgtaatatttaatcaatctaggttacagcataattcttttccaataaggagccaactactttaaagaaagaggaaagaaacacgaaatgagacttagtaatcaaggacaggtttattttagagaaataaacttgagagggtcttctggccaattttggtcaggagccttctctcttacagactgaggatatttaagggctttggaaggaggggcttatcgtaggtctagaatgtttctatgtgagggaaacttaattgcggggttggaatgtctctggttggaggggaggctgtctcggggttggcatgtttctggttggagaggggtttatcttagggttggaatgtttctggttatgctgacattagctattaggctgatgttttagggctggatttaggtggttttttaatcaaggggaacttagaatggtggtgtttgttcaagatggagatgctcccgctctgtcaactactgtctgcacaaatctgttgcttcgaaggttggtattagtaaacacaatggcctgcatttataaaagtgggttttcagttcttcatttcaagtttacctgtcatctttggcatatgtccctagagctctgctaccctagaaaatatacacattacaaatgtaaatcataaatagttttggcagatgaaacacaagacatcccattaaatttgaatttttttccattagacatacttgtactaaaaatttatctgttgtttatctgaaattcagctgtaacgataggcatcctgtatttttatttgctaaaagtttggcagtgctaaccatatatgaacattgtacatgtccataaaagagcaagcatttgatgagaatgcattaatatttgtttacattcgtgaataatataacaaaatacaaatgggatgcaagtcaataatgcaactcattttcactcaagaaacacgtaggtggaaaattcccttaatcaaagcaaacctttgatcagctgcaaaataaaagacttactctcacatgccagacatgtgttaatgtgcgtagctaaaataaagcatgggaggcatattagactcagaaacgtcctctaaaaccataactgtagtatctgaaatctcccacaaataatgaatgcaagtcggcacagactaacccaacagcagcaagttgggtaacatacattatatgataatctaaggcactgttcagcaaacgttttctgtaaagacaaagatagcaaatattttcacctgtgcagacatacagcctatcacatctacccaactcagccactgtagctcgagagcaggcatagacacagacactcacagtggaatgtgtgtgccagtgtcccaataaaactttatttacagaaacaggaagtgggccagaattgtcccacaagctctagtttgcaagccctacctaaaaggagtttgttggtaccttcttactctgttgataagcttttttttttctctcaaaggaagaaacaattgtaagaattattaaatgctgtcaatcttctgtcatagaataactaggaaactgaaaaggcttaggtgggtgagattataaaaattcaaactattctaagagcagttaagggcagatagttatgaatgaaatcaactagatttttaaataacatctaaattgtgagggtcaaaaagatgaagaggtctgcttatgtggtggactaaccacatatatgatttcctctccttttcgaagttcacgataatgacgttaaatcaatgtattaatgcataggaacaaacagaatggggaagacaggagtagaggaaatttcagcaaattttggaaactggaaagtgtatataaaagcactacctggtttggaaactaagtataattaaaatgtgggctctgtacacaggctctgtcctgttttgggggaggggtacagtcagaaatgaggaatttgggccctgactgagagtttttgaattgagatacactacagaatatgagcagtgagcctgatggtgagtttgcttcaccaatctcaacctcagcttttccgtcatcctcaatcatctcaccagagtccagtaataaagcaaaaagagctatatgaagaaatgttgaactagaaaagtcattttccttaaggattgcaatgtaaataattcttttcaggtctcaacatacagtccaatggtgtcatttattgggaagaagaatacctttagccatataataataaaaacaaagcaccttcaaggcctgaactagtatgggttaataatcctgatttgatcaaatgcaactgatgatgtatggatctaccagatcttcatgttactttggattaaaacatgcagaataaaaatattctacatgatttcttttagatttcatgtgttgttcaataccaatggaaacctaatttaccaaaacacataatactatatatacttaaattatagtcgatcccatgttatttcatcttataaaatgtttaatattctcccattaatagcacataaaattatatgggctactgggctgattaacttttagttttgtattctttattttttttatgcaacaaacaggaaaagtaagatcataatgcctaacagaattagtagatttaagtctgaattattatagatggtccttaattaattattcccaaaagcctaacaccaacacccatatttaccaaaagaatattatgccatttatcatattccctgcttaataagaacttgtagttttttacatcacactacaatactgcaaattttaaaatgcggaacaacatacagatttattcttgtttatgtagtctataataaaaagtggataggctcatttaattagctgttgattgcttttgttaatcagtcttataaaaatgtctattgtaatctatttctcagtaggtcttatcatgttttatgaaaggcatagtagctcatttatttgaattgaactatttagcctgactgttttgacaaaaggaggtctgatatggttaagtactttgttttgtttttgtttttgttttgtcactctatcatccaggttggagtgcagtggtgctatcatagctcactgcagccttgacctcccaggctcagtcaattctcccacctcagcctcctgagaagctgggactacagcaccaccaagtctggctcacttcttaatttaaaattttttgtgtgtgtggagacagaatctcactgtgttgctcaggctgatctcgaactcctggcagcaaggattcctctccccttggcctcccaaagtacaaagattaaaggcgtgagccatgcctggcctgagtacttcgaaaagaggactgatttgctaactgaaaagaggactaatttgaaatttcccatatattggaaagccttgcacatagatctaagattttgacaaaaacatgcataaagtagatttttattttaaaaaatatcaccttgggaaaggcttattataattcaacaatattacaattgttctcaaccctgtgtttattggaataaaaaaatccctctataggaaagattaacatgtaaaattaatactcatagtaatgagtaataaatccctttgaaattcagtgtttccaaatctttgtgttctccaaattgaaggaatggtcaatagtggttctcatgaggagggggattgttcagggaagatttggcagtgtggaggtacttttggtcaccacaactaggaatatactactgacatctagtggtagaagccaggaatgcagcaaaacatcctacaatgaatacacaggacagtcctccctcccctccaggaattatccagcccccaatgtcaatagtgccaaaggtgagagaccattatatatgaatatgtaaataaataataacagaaaaatggaggaaacctccactgatcccattaagagattcatgtcaatgaattttattgaaaaatgatcaatgtttatgttttaatcatatatacttatattttaaatgctgtatcttatgttgttttgattaactatgtgataataataaatgtattaataacacaagctacaggaaagtttttaaactcttagagtcttgtggttgcaagaatttttgaaaagtaaatatttacaatttgatgcagttttgttttaggtaagtaaaataagttatcaataaaagattttcaaatatcaaataatataactttaagataaaattgtctgaggagagcagaatagaaattaaaccccaaggaaaaaaacaaatgattgaaaattctcccctgttaaagaagagcatttttagggattttaattaactataacaggtgtcaaactgttatgataattagcttacatcggaaaagtttaaaagcgtgatgttgcagctctgtctttaaatatttacatttggaatatgccagaaatttcattctttccatctagttaaaattatgatgtcaaattgtagatgtaactaaaatgtgccgggagatgcacaggttggcaagattcttttagagagtattcaggtaaaaatgtttgaataccactgttgtacagagctgatccaattccctaaaatcgagctctcaggaagttaattaaggttccccctttagccataggggcctgcagacaagtgggtgataaatcccttcccttttgaaggtcataagcccctttctgtctcttgtagcctaaaagcattttgaacatcaactttacaaatccaaatagtcatcatgatattaaaagcttttaaataataattacaaaattattgggttaactgaataacattttcatgcaatgatatcaaagcaaaaagatttttgcattgtcagactcaaagaaggatccttttgtacgaagagaaatgatcctataactgctttgttggattcttaatttaaatattcattaagtgaatttaacatatacagttcataatcctcttcctttgagaaagaaaagaggtcatttatctgagactaagagctttccctacttaacaaaacccaagggctagaaatctgaagatttatttcaaattttcttaagggcagttgaataatgtataagatatacaacaccagatggcagtatttccatgttctagggcatacacacacacatacacacacacacacacacacacacacacacacacacgcacgcacacatacagagacatatatatatctatatacaagtagacaaaaaacggtgtttctatagtgaccaatatcgggcaggcagactttaaaatcagtatgacaataggcacagatatttacatcagaaatttctctttacacttgagatatgtgactcatttttcccatatagttcacttaaaaacagtttataattattattttttttcttatttactaaggcagcaacacataggtaggtaatccatataaatattgacaaacaatgaaaagaaaaatgagggaaaaaattaccgaaattgccaagctagcatataatatcagcaaattatggcttaatttaaaggttttctttctttaaacaacaaactgtgtagctttacctgagcctaatatacttacatgaaagactaatatatagataaggagatgtagtcatatacaaattacatgaaaaatgtacatacacgttaaagagaggaaaacaatttttcttttcacgtatattccatagttggttgcaaaaatacaattagttaacttttcagaattaacctgaaaaagtttgtatctgtgaagccagtgagatctgttactttgaagttgcataaactttataggctcttaaaaaaaaaaaacaaaaaacctcaatatcttattcaattgcttcctttctaagaaaaggaattattcacccacctggttctcagtactaaaagaggaaaccagcatgaaattgcctaatctagcacatattaagcataataggtgtttattaaaacaataatcattgattagttattattgcttgttaattaggattatctttaaaatgaggatgtggtgtatgaatcactcaagaagaagaccaaccctaaggaaattaggaattttctagctcccaagtcccctcttcctatgctttgctgctccgtcaggtggaatatcaagccaattacaccgtggggttttttttttttttttgccaattttgtacccactattactctcatcaagattagattttatacattactattaacttaaaagaaaaatacattactattaacttaaaagaaagttttcttttaacacatatatattgatgcctgttgtatcccatttagtttacaaggcaaacatatacattttattccactgtgctcatctgacaatccaaaaacagaggattcgactaggaagttttgtgacttaggtcccagagcaaataaagtgtagattctgggggtttcagcaaaggtctgtctcttcccttggtccatgcactcagtaatgctccaggctaccctggacaaatctttccttgttagaagaaacacaaacaccagcagagcagagaagttttgtagaaggcacacaccatgacagcagtcaggggccctgaaaaaaagcgaccataatccaatacactcccgctcctcttctgggtttctccatcctactcaggcttcaaacatgcatcttttcactgtccctggagcatattttcaaatcatttggacagatgggttgcttaggctttgagttccctatttatgtggggtgttcagaatggagtattggcgtggaatttacaggcactgatttcttctagcccttgtcatcaccatcatcgtcatcatcatcatcatcaccatcatcatcatcatcatcaagatctcagattaagcgtttcctccctgtaagtttcttctcaatttctgacactaactccaaagaccatgcatgtgccagactgccctgatgatggttgtacagggttgatccaattcccttaaaatggactctcaggcaattcaggttcctgctttagccataggggcctgcagacacatgggtgataaatcccttcccttttgaaggccataagcccttttctgtctcttgtagctgaaaagcattttgaacaccaactttacaaatgcaaatagtcattcatgatattaaaagcttttaaataataatttcaaaattgttgggctaactgaataacattttcgtgcaatgagatcaaagcaaaaaaaattttgcagtgtcagacttaaagaaggatccttttgtatgaagagaaatgatcttgtaactgctttgttggattcttaattcaaatattcattaattgaatgtaacatatacggtatttagaatcctcttcctttgagaaacaaaagaacacatttatctgagactaagagctttccctgcttagcaaaacccgagggctagaaatctgaagatttatttcaaattttctcaagggcagttgaataatgtttaagatataacaccagatggcagtatttccatgttctagatcacacacacacacacacacacacacacacacacacacacacgtgtgtgtgtgtgtatatatatatatacatatatataatatatttgtatatatatatgtatatacacaagtagacaaaaaacagtgtttctatagtgaccaatgtcgggcagggagactttaaaatcagtattgacaatagacacagatatttacatcagaaatttatctttatacttgagatatgtgactcatttttcccatatagttcacttaaaaaacagttcacaattattattatttttcttatttactgaagcagcaacacataggtaggtaacccatataaatattgacaaacaatgaaaagaaaaaatgagcaaaatttggcgaaattgccaaactagcatataatatcagcaaattatggctcaatttaaaggctttctttatttaaataaaaaactatgtagctttacctgagcctaatatacttacatgaatgactaatatatacataaggacatgtagtcatatacatattacatgaaaaatgtacatacacgtttaagaaaggaaaacaaattttcttttcatatatactccataattcgttgcaaaaatacacttagttaacttttcagaattaatctgaaaaagtttgtatctgtgaagccagtgaggtctgttactttgaagttgtagaaactttataggctctttaaaaaaccctcagtgcctcattcaattgcttcttttctaagaaaaggtataatttcacccacttggttctcagtagtaaaagaggaagccagcatgaaattgcctaatcttgcacatatgaagcatagtaggtgcttattaaaaaatcattgattagttattattgcttgttaattaagattatcttaaaatgaggatgtggtgtatgaatcattcaagaagaagcccaaccctaaggaaattaggaactttctagctcccaagtcccctcttcctatgctttgctgctccgtcagatggaatatcaagccaattataccttatttttttgccaattttgtactgactattagtctcatcaagattagattttatacattactattaaataaaagaaaaaagtattcttttagcacacatatattgatgcctgttgtatcccatttcgtgtacaaagcaaacatacacattttattccattgtgcttatctgacaatccaaaaacagaggatttgactacgaagttttgtgatttaggtcccagaacaagcaaagtgtagattctgggggtttcagcaaaggtctgtctcttcccttggtccatgcactcggtaatgctccaggctaccctggacaaatctttccttgttagaagaaacacaaataccagctgagcagagaagttttgtagaaggcacaccccactgcagcagtcaggggccctgaaaagatgagaccataatccaatacattcactctccttttctgggcttctccatcctactcaggcttcaaacctgcatcctttcactgtccctggagcacattctcaattcatttggacagatgggttggttaggctttgagttccctatttatttggggtgttcagaatggagtattggcgtggaatttacaggcactgatttcttctagtctttgtcatcaccatcatcaccatcaccatcaccatcatcatcatcatcatcatcatcatcaccatcaccattgtcatcatcccatcattaccatcattaccaccatcatcatcatcatcaccatcaccattatcatcgtcatcaggatctcagattaagtgttccctccatgtaagtctcttcccaattcttgacactaactccaaagatcatgtatgtctcagaatgccctggtgatggcgctgcagatatttaaaccccaaaactggccttcagcaggcagagccgactcctccagcctttggaacacatggtatgttcctttaaatgcagacttgtttgctgagctcccacaaggcagatctcagcggcactcacccaaatgccatcctagacaaagggtcatattttatcccttttatcagactctcaaggagtctagagtcagtcaaataaagccaagctggctgcttccaatcaatgacccagaatcccagcactttctcacccacggcactgttaggagcttcagataaaaagcccacatcactcccctctgctgctacttggttcttaggtgatgttttgtggtttcctgcacctgagatagttttggtgtcctagttagtgtgtggatttttggatgagcacatatagagcacatgctcgtgagtacacacagcctataatgactgagttatgagattgttctgcagagaccagagggcccagccagtcctttctgcttctgctattgagaacttcaggaactgcttgcaggactgagtggagaactgatggcctctctgagaccctaattctggacaaggcatcatgtacttaccgcaaggaaactctggccctgggctgcaggcaatggatgtctcctccagacttccctctccttcctatttgacttctgtagctttcaggtacctttgctattttcccttggccgcttcccattctctttatttaagtacatcttaaaggatttatcgaaatcaatacagtgtcaatgtatatacaataagagagtaaaaatatttggggcggactgtaactcctgacaccattttatttgacttcgttagcatgatactggcaacctggcatttgacagcctcctttagaatgaatcacctaaacacttgtcaaacattgacctgaaagttgcccaaacatttgtctaaacattgccaaatattagattacgtgacaggggtctctgtttcccttccgaattgtgccattaaactgccatttgaactggaaagttccagttcagtgtctcagaaaatgtctgtttgctgcctacttcaggtttagcagcacagaattaatttgctgttgatagtattccttggaaaaagatgctgtataagcgtatcggccatgtaattccaacgtgagcctataccaagtctcagattcaaataatgttctctgtaaataagctctttcttgagtttgccattgtctagcctttaaataaattactggcatcatgtctccagtttgaaaacatacagtgcaactagaaggatgtttcttcactttcatgcatctttgcaagaagttctcaccataacaaactgtgtggtctgcgtcattcccaaaaattcctggagattccttcttattttgtctcacatttgattcccactcttcccttcatcaccagaggatgataaaatggagaaaacatgatcttagaattcagaaacaagtgcaagccattattaaaagtggaaacatattttttaaagaaactgtattgttacggaaattctcaaacctagccccacatagaaaggacagggtaacaaacctcctggtactctgcccagtgcattcagcatcaacatttttcatatgtcctacccatctagttttcctttagtggagcattttatttatttatttatttatttatttttgtgacagagtcttgctctgtcgcccaggctggcatgcagtggcacaatctctgtttcatgcaacctctgcttcccaggttcaagcgattctcccacttcagcctcccaagtagctgggattacaggcacacagcgccatgccctgctaatttttggatttttagcagagacagggtttcaccatgtggaccaggctggtctcgaactcctgacctcaggtgatctgcctgcctcggcctcccaaagtactgggactacaggtgtgagccactgcgcccaggcctagtggagtattttaaaacaaatctcagaaatcaagtgatccactgtcccaatttgtccaggactattctgatcttagcactgaaactcccacatctcaggaatcccttggttctgggatggcagccacccatatcattattcatctttaatttttttcactgtctataattaataaaggattaaaaaaactcaataccaatatcacatcaaacaaaattaacaattgtttcttaacatcacctaatgccaatcgtgttcattttttcttgactttcagcaaaaaatacagtttttacagttaatttgttttaataaaaattcatttggtgaaaacatcacctaaatttattttcatcgatagcagttccccctgcctttttctttctgtgtcatttatttctgtaagaatctgagtcatctttttctataaaaatgttccgcattttaaattttgcaggttatatttttgtggtgatgttttacatacttttttatagaataaattgtctatatattcccaattacctctagaaacttgattagataccaggacaatttgttttggcattcatacttactggtagtgctaggtacttctcattgtatcccaacaggaagaagattaataattaccaagaagacctgtggttctgcaggggtcaccctgatggaactatttcaaagttctttatcaacctatcacctaaagattttagcagattttgatgatcattgccttgatctaaataaatatatcatgacaccataatatgtaatcatcaatatatcaatgacaccataaaataacatggcaagtacccaagtgcaattttctctttcaaatattcattcttcacttattagtatgattcttctaaaacaaatacacttccaccattgaccatcaggttatcttggagaaaaatccaaacaaaaaagtcaggatacatgtgtatttttttaaaaaaaatattcattttcagagtaaatggctggtacccaaataacttccaaagatgacaaagttttttggggaggcatacgggtagatagcgggagaagtagcattttgaactctctggtgcctgttctttgatgcatttccatcattcccttggctgctgtacacaagcaaatgtatttgatgctctaccataatttccttaacagatgtgcatatggaaatttgcaagacaaatttgcatttggcacagtatctttctattctcctcaccaggtaacctttacccatttcaggagcaatcatgatgaccatgacaagcaagaggcaaaattattaaacaggtaagagatacctgcatacttttgtctcagcattgttattattcttcccaaccctggccccttgacttcctggagggtgacatttatgtccatcgcaatcatctagccttgcaatcaccaaaccacacattatacttcaaaagccctccttcctgatgcatcccaccactcttttcctttaaattctccttctcccatttgcctgagatctcggcccacaggagaagagcagtatcataaactaatgtacagtgagctaagtgctcttaaccacatagctccaatatgttccatctcttcttaatccacttagctagtcccagaatttacattttaaaataaattaatccttggatccaaggaaacattggtttaattgcacttttctagaatgtcttgagtttttctcctttgagattttgttcatgcttttcaaaactcctagaatacctctcccactttcagcaattcaatcctttccctcccttcaaatctgttcaaattctatctcctttgttataacagtcatatatctttggaactcatgggattactgttatcaaatcccttgtaaaaatgcttttactcttgtcatgaatgcttatttcctataatgttgtttaaccattttatggacttaaagtaagattttcctactaaattgcacactttgagtgaagggatggtgtgttatattttaaacatagtacctagaaaggtgtaagaacagcatcaatatttgtatcaatagtaaattactggtaagtgctttagatgagaatggggtcatcggggacaattccaaaacattctatttactactaggctgataagtatttacaatgcctgtagctcagcatgatatttccttcaaatcattctactattgtttaaagtttctatttttcatctctaccactagaaaatcatgtatttctgtatagataatgtggctggtgtattttagaatacatgtaattcccagtataacctatgctacccgacttgacagagaactttttctagaccaccagcatgagtcaagtttcagtgaaatattgattcattacatttcatacacttttaatatgagacataaactgatatctccttctaggagcaatgtggaaatatatgccaaaaacctcaagactgatgctaaccttagtcccagctattccacctttatgaagtaattctaagaaaacaatcaaaggtatatactacgaagatagatgcacattaattcgcctcactgatatctaaaacagtagaaaattggaaatgacctgaatgtctaaaaataggaaaataaaccatggtagatatgtataatggaataattactgaaccattaaaatattttctaaaggaaaagctataaaacaaaattcactattaagtaaaggcaaaatggtttagatgcagtgactaaaatgtgtatgtaaaaaattggctagaatatcctgaaaccttaatagtggctctctctgaatgtgagcattatgggcaatttttattctttatggttttctaccttatgtttttatatgctttccaaattggctaaaatgaataaatattatttttaaacccaaaaggtgttatcctataaaatatctaagctacatggcagttttatgatagctatttaaaaatatacccataattatgacccagcaattgcattgccaagtacatacacaacagaaatgcatacatacatccaccaaaaacatgcacaaggatattcagaaccttttggggtggcgaaaatattttggacctggataaaggtgacaggtgaacagttttgaatgtactaaatgccactaaattgtacactttacaataaatactttcatgttaagtgaatttcacttccaaaacaaagtttttaaggcatattcagagtagcactatttgtaatagagaaaaaaggggcaataatccaaatatcttacaatagcagaatgggccaataaatggtggtataatgaaaacaaccgactgctgcaacaacagtgaaaatcaaggaactacttctgcatccaggttcatgaaagaacctccacatttaccaccaagtgaaagaaggcacgaaaagaacacactatgatttcatgcacataaaattcggaagagattcaagtcacttatagtgtcagaagtcagtttcgtggttacctgcagggagggaggtagtgacaaggagtaagcatggggtgggggtcccgtgtggatgagcatattctgcgggcttatctcaatagtggttgcatacatacattacccatagtgagaattcatcaaattgcaccattacatttgcattatttaaacatcttcttgctttcatttttacctggctgcctgcaaattctccagcccctagtgaccaccttgctgctaaatttcttcttcagttaatgagataattctctctcttcatttataaacttggattctattttcatcatttccaagttttgacattccacccattcactccacatgcattgaattctagtatgttctaggtgcaaggtggggtgatggggagacagaggtggtctcagcactggcaacccagaaagatgacacatattagataaagtttttaacatccatctaggtgtggaactttttctagaacatgcatgttaaaatttgcatatattttaaagggctcaaaatccccctggagactcttccccagttcagatcaagagcctggctttatagacaatgcttcataagaattcatcgacatttgtctcctgtttttattaggtaataaatgaatgtttgcttttctaaataattaaatttacacgttcttataaattggtattttaagatcactttatttggctatggtgttatatgattattctcccctaaattggtagcacatcttcacactttctgaaattcaagaattcttctgaaaagaagtcctatcaagtgtcctaatctctttaagtgcattagttaagaagctatttttaaagacccacacattacactgtactgaatcaacacagtgatttttatctgctcaagataaaactgataccattgtaattaactgtttccaaaatattttgacatgtatatttttcattagactaagataactaataataaggctgcttgttcatagctaaattacacaggctaacaaaatttaaaaatcaatttctaaattcttaatactatgcagccaaatatttcgctacatggaaaatagttcctggcacttggatttcggtaaccagtaaggctgataagaatgaaactgggctgggagcggtggctcacgcctgtaatctcagtattttgggacgctgaggagggcggatcatctgaagtcaggagttcaagaccagcctggccaacatggtgaaaccccgtctgtactaaaaatacaaaaattagccgggcatggtggtgggcgcctgtaatcccagctactggggaggctgaggcaggagaattgcttgaacccgggagggggaggctgcagtgagccaagattgcgccattgcactctagcctgggcgacaagagtgaaactccatctcaaaattaattaattaattgattaattaaacggatgattaatgctgcaaaagaacaaagccatattttaatttgtagtgctaattaaaccaaagaagtttataccaatttccccaaccatgcaaagaaaaaagaaatatgaaggaactgtctcatgggaataggcaaaaaggtggcatgctctcacttaatgtcattcaaaattgcaaaataaaaacaaataaagaaactgcaatttaggaggtgcattcacaaattatatatatatcacgtgtgtgtgtgtatgtatatatatgtgtgtgtgtgtgtgtgtctgtgtatgtatctctctttttccaagaaatctgatgtgctcccttagaagacgtcaaccatcctccattccaggatgagaaataccttcataatcttgtcataaatcaatcattttccagattttgtccagttaaatgttttgtttttcattttcttaagagttttcacatatcttataagcatggcctttgtgttcctgtcttgtgctaagcatgtatcacaaattgcatctgactgtgcatcttctagctttcttagcaagaagtgcatttaatcctgtgctttttaggaaaatggacacctcattccttttcagagttaaataaattgtatgctctaagctgcatcaagagtatatctatcttctaggtgaaaagatgccctggctgtgaggaattatctaaggcttctggaatttcaaaaggtgaactctttattgccccattttatgcaagatcccttctctacttccttcaaaaaagtactattcattcatggaacattattgcattgggctaagactttggcataattataaacagtactttctcagcaaactttgagcagaaatacgaacaattggctgttggtgacaaaatctcttgggctattcttacttaacctgagtttcagaggtcggggatagtatagatacagaggcaagacaggggcaacaatattctggagtaagagagaaacttctgtcaccttcaacctctccctctatttcacaccatcaatcataggttacaaggtccactcaattctatttctactgtgtttatccatgcaatttgtccccaaaattattgccagactctatataaatacaagttgtgtcttgcctgaattatgtccataatctctctttggcttgctaaatctgggctcttctcacttagtatataatggcttcccactacataaaactaaaagcacagcctcaagaacatttaaactcagatcatatcctttcatttcatttaatgtagagccaccccattttcaaatcttgggtttaagctatgacagacacttcattgttacctgatgaagccattcacactcaggtttccatgcatttgctctgtggaaagctgcctcctttcctcccttctctcactgatgaacttacatccacccttcaaactcagttctaatttggcatcatggaccacctcaagccccaaggtagaattcatggctttctcttctctatttctgtttgtaatttgtaaactataatttataaagcacaggtatgatgctaagctgtttatgaggctggttatgcctcacagtgtgaattccttgagattagcatccattcatttgttttagtgtccaatatataacaagaacagcagccccataatgaaccagttatggtgccctgatgcaagatatttgggatgtaaaggtgaacaagcacagtccttgcttttaaggaacttccagtccagtgactcagtggtcaataaatgcgtattgagtttaattagcatttacttatgtcatgtttgcacaatgacttatggggtagcttaaatgatgacagacagcgtatctcaactcaatcttcatttgtgagtacagatggattctgatcttgtgaactggctagtcactttgttctactgattacagcctaattggttctctaatggtgattgaaaacttctacatcatatgcagttgggatgagggaaccccgtctttagggttctctaggaagctgaagtgtcccgcccagtgcccccttcttaattcccatcaggccttaaaatcattatcagtccattggaaaagcataaagaaaagtctcatccatgtgggtgcctatgacatcactgagctctgaagtctgaggttgtcaaagaaggtgccctttgggaagctctttccttcatgaaagtgtcatagtttcattgtttcacaaaccctatttgagaatgactgtaaccatcccttttagctgtccttgctgaattggcaaataggattttcattacaggggatactatttttcccacaccaggtcaattccagctgttagtgctaataagagacatcttcacttgagagttggtgctcaaaacaatgcttcattattggagaacagtactgtacaggcaacatccagtgcccacagaaactaattctctcctccccaagaacacctctctttatggtacagctgcattcctgaaaattttaaggcatgtttaaaaatcaacacataccctgaaagcataaagagtacagaccccataagatactcattttcaagacccataaaacagccacatatttacttctctaatttaaagttttccacttggggattatatatccctacactcacattctacttatttctacaaatagtaaccctgcacgctgtatcagaaaggacaagaagtactgaatatgtcttttgtccttaaaaggaaaggctgttgtttggcaaaggatgaataaacccttccctttagaggcctgaattaagttcacattcaattgctttgattagatactaaacctagcaaattaagttccccattccaggtgacctccggaagcattattaggaaaaagcgtgggggaggaaaaagaatgacacttaaattcagttaatcattaggatttgtttcaataactagtcacattcaattgcaataatataaagttttaaattagccaagggtacaagagtgtgaaaagagcctttgaatattagaaagacatttttctattcaaatgaacagattataagatgtcaacagcttgcctactgtagccaaaagaatgcttgtgaaaagggcatgttgataaaaaaattaaaatgatggtgatagcaatgagaggaagaaatcacagggagaaaatttctgagaacttgggggagtcaattcttcctccctgtcttttttatagattaatatccttgctccctggtgcaagtcagcatagcccaattttaccattgcaaaatatacaataaaaatatggagtcagggccgagtgtggtggctcacgcctgtaatcccagcactttgggaagctgaggtgggcagatcacctgaggtcaggagttcgagaccagcctggacaacatggtgaaactccgtctctactaaaaataaaaaattagctgggtgtggtggcacacgcctgtagtcccacctactcgggaggctgaggcaggagaatcgcttggacccaggaggcggaggttgcagtgagctgagattgtgccactgcactccagcctgggcgacagagtgagactctgtctcaaaaaaaataaaaagaaaaaaatatatatagtcagttactagaggaaaacaggaaatacaaaatgacattattaatatgcaacacaaactgtccgaaggatgaaatcttgaaagcagagcaagatttgctttgatgaagccattctcccttgtcacgagattattacctttagcttttgcatctgacagcaggactccatctcaggtacaaacagttaaactgctgcacctttatatgctggaaatggattatgggcttccaagaagtgaatattaaaaaagaatcttatctccgcttctctgagagatgtcatacagtttgttaagacaggagaagctgaaggtaacagggtgatgcctgcctctcttgctgtgccaaatggggataattaggtctcccagctgcaggcttgctctggaatggagaacattgcttatatatagcttagtactgatggtttggtgggtgtctcattgtccataattatctttaaagttagatgttggcaaagaagtgattttgctgttaatgtatttttatataccaaagactctgatagaagatagttcattctaccatgtatacctcacacacacacacacacacactcacacacactcacatacacatacatacacacactcacacaaactcacatgcacacatatattaattgacagagcaatgtactgggaaaataaatacaaccccttaagatgagaaaatatgttattttctctcctggaaatgttagtgtttcatgacaaagtaattcagttatttgtcaaaatgtctatggtgacagagtggggaacaaaaagaccttaatttgggcatcttcaaccaagggcactgaagtgaaccttgacttctaagaaattgatatctcctataaaccccatcaaaaatgactgttgctatttgcagagacagaaaggagatgagaggctatcaggggctggggcaagtgggggatgggagttattgcttaatgggtacagagttttccttttgggatgatgaaagagctttagaaacagtggtgatgtttgcacaacagtgtgaatgtcattaatgtcactgaattgtacacttaaaaggttaaataaatgacatgttgtctgttgcaatgattttatgataatattttttaaaatgttgctacaaccagtcataatggaagtagacttccatccacataagaataatgatggttgagctgtggatgcatccactattggatgtttcctttcattggacccatttggatgtaaatattttactaccaaaatgggacaaagaaaacctcacagaaacagctttgtgactatgtgtgctctagaccatagggtaaagtaactcacctttatcacagacactccactctcaggctgcatcgtcagggcagcatctttcctgcaaactgtttcatagaacggtatgtccttactggtgaactctgactttatctggtataggtattcttttccttctgctaggtgatccaggacaacggtttgcttggggtgtgaccattgagaaaatagagctgatcacacaatgttcagggatgttctgaacacgagagtttctgtatttaaaccacttggcacatgatatcaaaatatgttctactttccagatgacattctgaggcttcagaaggcatagtggctccactgggctaggaagaccccaaagaaataattctaacatcactaccctgagttttccccgtgagggaggcttcagaaagaagcatccatggctgggatttctctctgatgagctcagctggcaaaagaagctggtctaagctgatttttgcacatggggagatggaacctatgtgccagcccttccatttttttccccattgtgttttatatatcgaagaagaatttataagcactcaagtacaaccttcactgtttagtgcatcatgtctttttacatttgtaaatagccacataacaccaccaagatacacaaatagaaacattttgctgccccagttcctgctcctctccccttccctgatctgatctctactgtgacatccctcaacatggctgcgtttggctattcttgaattctgcatcaatggaatcatgcagtacgtaactcttgcgtccgtcttcttgtcctccacgtaatgattttgagattcagccatgttgaatctctcttcagtttgttttttgtatgactgactagtatttcattgcatgaagagaccaaaatgtgtttataaattatcttgttaatgaacatttgggtcttttccagtttcagttattatgaataaagtgatcgtgaactttttgcatacgtttctttgtagatgtgaacattcttttcttttgaatgtgtacctataagtaggatttctggatcacatggaaattttattagacactaacacttctccaaaatgattgtatcactgcacattccaagcagcaattaatgagggtagacttaatctatattgcctattacctataataccatatcttaaagtaattttatttttaatattacaataataaagtatggaaaataaaacatcacagaatagtctcaggaattccttctttccttaaaaatatctcaagttcttaggaaccacacacagttttaggtgctaaggttaagtgaagaaagaaagaaaacagaacaagtttccagatgttgcaggggttacattgcagagggagaatcaggtcaataaagaagaaaattaataacaatataatttctactaagtgttataaaaataaagcacattacaaagacaaaaataattgctgagattgcagaataaaggctacttagtgtgtgtgatgaatgctcttgtaggaggtaatattgaagctgccctactggctgggagaaatagtatcaaatacttccagccccgtgaacctgaagatgcaggcatttttcttattctcttgaatgggaggcagagacttgtgaaggacttggttggatttatacaccattcctgaactactggctgtggccggtgtgatgggctccaggaatggctagctcgtgcagtgaaatgggactttaggacatttcagcctgtgaaggacataaacttcagctgttgtatgtgaatatttgaataattgcttaggacagagtttagaacaaccagccaagtggatagttctgattccctatgcatttactgattatcccaaaaactaatgttgtgtagctgtctttaaaaaatgaacatagaatcaatgcaattaatcccactgacaatgattatagctcactctgtgaaaaccatttctggtaacgttacaggtaataattcaattaatttgatccattatgtataatggttttaccttgtgagtctggggaatagaaaacgatcttttgatttaagatacatctctattattcatgaaacgtatggtcctgaaaagggacgatcaattcatgtaattgatttgatatccttgttgtgagtagaagtgttgaacgttatttgacaggaggatatgagaattaagtgattctatgcaggatagatttagcttctagtttctctgttgcttgtttctgtttttgtcatcataatggactcaggatcattcatttccaataagaaaatgtcatgcaggaatgatgacttatagcagttttcttagatgactttctttattggtttctgttttccttagaatcagcatcctcttgccatctctaatctcatttgccccatgataaaaggttgggccggaaagtacagaggatgctttattgggattcaacacaccaagtgcttcatgggagaagaaagacacataaaggtttgggttaggcttcttgagatggatacaacttttaactcatcgaggggcatgaggaacagggtatatctgggaatgtctgcccacttctggctgggtgtgcagggtgtgcgtgtaaagtgtcaaagacttccatcctcccccatgttcgcctgcctctctgggcaaaactctggcttatcttttactacaggtgtgacaacgctcttctttcatgacacgtctccctgagagcaagggtggcattcagttggtctttgcatcctcaacttgtggtagccaggcacacaatgagcacgccgcgcatatttttatactgaatgaatgaaagcgaaaaccacccaggagaggataataaaaggctcatccgaggaattagacttgagtctgggggtggagccctgcccgcaaaccctcctctttccatcttgctttattctcccactgtctacagcagaacctcttcattctctttggggccaccagcccaggacccaccccacttaccctcagcagatgaaaagaagccctgcttatgggaacaatagaagtcatcagttggaatgactttatcttcttacctctaaatttaccagcatctgcacactttacttttattctctttttataagtatgctttttcccatgaaagccaaactgtgaccttatcagcatcccttctgtctctcctgcattgctcaagtctcctctctactgactttttaaaaaaaattttttgaaacagtctcactctgtcacccaggctgcatggcagtagagcaatcatgactcaccacagcctcaatctcctggactcaagcaatcctcccacttcagcctcttctgtacctgggagtataggagtgagacatgagacctggctaattaataaaaaaaaattgtagaggcaaggtcttggtgtgtttcccaggctggtctcgaatccttggcctcatgcaatcctcccgcctcagcttcccaaaacactgggattacaggtgtgcaccaccacacccagcctctactcgcttctggtcatgagcgcttaaatatggcagtgtctctcctacgttaaacaaaaattcctggctctcctattccaattaaaaaccatgtttcctctccccttatttaaaagctgtttatagtcactattttccatctccatttcccctgtgctccataacccactgtaggcctatttctgcacccactgcttaatcgaagctttcttcttgctatagccagtgggcatggtgtcatccatatcatacttggcagcttaagggtgctggatacagctgaaccccttcaacctggcttccaggaaggcccctctccaattttcctttctgctcatgttctctgtccgtcacctaaattcaagctggtctgtgtgttctcctacactgaagcagatgtaggggttggaaatctctgaatatgaaataagttcccagaagattcttatactctgacctctcagaagcatatttgcaaggactcatattcctcagagatctgcccatgtcttcaatgtatcgtttatgaaagacattggcaatccacaacccattggccagatctagatcaccacctgtttctgtaaggcaacttgtattggaacaccaccaccctctccccacacactgaagtatttctgtggctgctttcaggccaccacggcagagctgagtagtagctgcaacacagaccatacagcccacaaaccctaaaagattttctatcagaccttttggaggaaaagtttcctggccctggtttagaatctcccagttgcttctggacatcaatagccttctacatgtgtgtctcttgtgcttcagacccggagaaccaacagctcattggaacctcatgtgaacatgacacagacccttcaaaccaaacatgctcagttgaattttccatcttcttcccaatttgcccctcctctgggtgttataacccaggagaaactatccccacctactccagggttgattcccaaacaccctttctctcagtcccccgtcctaaaagcacagaagcctgatcattctgaaccacctgctctgcagagctctgatccaggccattcctctggcattcctggaaatactcctcacttgtcgcccccatttttaaccactctcctcagagcagcacgagccttctctttaaatggtgatcttaaccatgttttctcttctgcctgaaactgaaacctttcggtagcttccctttgccttaaggataaagccctagttcttagacgtgacctacagtgtccttcaggatccaccctccagctttctctttgtgatgttctgctccacatccactccacaatcattaagccccagaattaaaagtgtggcttccattcactaaaaactctgtgtgtatgcttgcctctgggtttttgcaggtgctgttccttctgcctggagcacctttccagcctgcccccttccacaatgtaactctccttgcttctcaccctcaggccagatatcacagctagatggggttccatgccatcatggggctctcttaacatcatgcatactccaaggcatccatcatgcattgttgggtgttgcctatgtctattcttaaaaggaaggttccttaaaaatctgaattcaaggttctttgctgatcatagaactggctggacatatggaaaggatatgctaaatatgccttaaaaatatagatcatttcatgaatacgtaatgcagaccttttgatattttaaaatttattttccttagaaagagagcttggaggaaacatgaaatcaattaggcagctgtgacagtagcccagagcagagctcaaagcctgattttatggaaaatagaaaggaggggtgaatcagtgtaaaggctgtatcagcccactcaatggaacattattttaagatatatttaagacaacatatggtattaaacagttatactttacttaaataattgcttacatatgcttcaaaaaatcacctgattgtagaccaaattgtagaaggaaattttaaaaacacactaattttctatttaaaaaattttattaaaaattgcaaaatgcagaaatttgacaacttcagtttttatgataatgtgaaattgaaatcatagaagaacatgtataactagtaactaaactatgtaatcttttatgttacatataatacttactgggtataccatgtaaaaacaaaaaatatatatatataataaaggcattctctaaattctaaatgtttgttcagtgccatagagtaataatatagttcttcagttgtcttgcactgtaatgtaaaagaacagaggccaatttaatacataagtaatggctatgcaccaacagaaggctaatgatgtcattatgtaatgtacaaatgaagactttgcagcaactttaataggacaagccagactaggcttcagtcatctcagcagatggagtgatatgggcatgccgacctggcagcaccctgcacctgtctccctgcagcaagcagaagtcctgccggatctgatccttactcatgcaagccttcattggcagaaagtgtagtcatttcaaaagcacatggaaaaacacttccttaaattaagatttttaatttgttaatttatctcacggtgacctcttacattgattatgccttcaaatactacattgatgattgagttcattcaccgttcagaaagaaaatgtaatcatggcagagactaccgttcaaatgatggttcatgatgctcaaagtcaaagccaagtcaatggcagtacaactgtaatcacgaaaaatcatcttcttactccccaacccaattgtggcaacttcatcacttgaaattaatgttgtcagctttatttaattttatgggttatgcaccctctaaatacacaaaattgttttaaatttaagcctaacacactattataaactcgttaataaaattttaaaaaatttacgcactttagaatttggtttatgcttaatttggatgtttacttttatggcttatataggttagaaacatatggcacacacataaaatatacctacctacttatatatttatacacatttaaatatagtgctgttaaaagataattttcggaaagggtaaaatcatgactgcgtacatatataaaagttaacatgtgttcatgactttatttgagtcattaatgaatgagggaaccagacagatgttagaaccctttcaccagaaaagtcaaaacagcacaaacgtacctggaacaaaataattgaatcacaaaatggcagcaaagctggcttttccaaaggtggagagggaagtcaatagaacctgtctggccaaggcagagtttgcacacctacttgtacttgcaatttataagagatgcaaagattcagggctgcatcccactgcttggaaagggacgcttagtggcaatgcttaggtgttcacctaatttttctctacaataaaagtaattgaatgctggactgaagttcaatgaggaaattcttttttaaacttcaaatgagatccatacattattcaagtatgaataatttaatcccaagcacctaaagaagactgcttaaatatgaatatttctcagatgagttctttctgataagacattatatgtatttgttgtaccattacttttttctgagatgggggtctggctctgtcacccaggctgtagttcagtgacatgatcatagctcactgcagcctccaactcctggtctcaagtgattctgccactgtagcctcccaagtagctgggaccaggcatgcgccaccatgcccagctattttaaaaatatatattgaatttatacattcatatatgtagatatgtatacatatgcacatgtacatgattataagggacagtcctgcctgtagggaaaatgagagaaaacaatcagcctgagaagtcaggggttgaaaggaaaatgcatttctaaccataagcagagaggaaacccacacagaactgagaggtttaaatttcatggcagcctggccagcacgtgatcagagagatttgcatcacatatgcaaatgcaataaaaataggtgtcagtattgattatctttcatctgaagaattcagtagtcacatttctcaatagcaggtgctgagaacttttatgcctgcactctgttgggtgaacaatttagtcacttgaccaagtcatggtacctatagaaatgcaataatccccgcttaaattttcttataatgaggtgggatggatagtctattgttacattttttaagctgcataatgtaaataatattatttttggtcctgtaaaattttttgaaggattttcaatgaaaatgaaaatgactctctgaagactggggaaattgttgaaaggcaggattttcttacttttggcctcttgctcaattcagctgaaaatcacagcttgtcttctgaaatagccagtgccatttgaaatactcagttgaaatggtgttcgattgtaatgtgcttaaatgattgaaaaagtgaatttaagcaggtttaagtagatggaggctttcaataagtgttgtagtcatttattcaaagtatttcacttaaggaggtaatagctgactcattcatataactaatatacctcgtgtaaaataatgtatgctatttgcgaatttgagttataaaaaatgctttcatgtttctagtgcatagcccgtaaagccaggtatgtggaaatttacagtccagttttcctcataggaatcagctcctgccgctatcaaacagatatttcttcttccattttctttggttcttatggagtcatagtaaatagcctttaaactaaatatgctaccccatggagccccatccaccacaccaatattgaagaaaaaatgatacagctcattaaaacagtggtattttctgtaaaatgggaataacggtagtatttccaaaagattattagattctagaacttcattacactccactgacccaacaaggagctacatttttatgccaattatttaatgaaagggtcataaaagaatgttcaattgtctggaaatatgtcccaatctccctccagaaaattagtattttgttgttgttcaatgaagtgaaagttagggaataacttgctgaggggcttcactagaaagccagtaaggcattttcactacagactagagccaattccatcaactgttaacaggcgcccataaaatgccagatgtagagcagtccaaatttgtttatttgtagcattagcatgcattctttcaatatgcagaaatcctctttatggccatatgcacaggtgtgtctaccgtgtgtttaaaagagtgacagtatttctccctatcacaaggtcaaaaacctctttccaaagccaacccgcacaaacactggctgtttcactgttgtgtatagtggctttcaccgcctgctgttctggctccacactggggctttggaggcctttagttcatacaagacgcattgtggtttgtggtcagcagaataatagctccaaatatgtccaggtcctaattcctggaacctaggaatacactaggttacatgaccaaagggactttgcagacgtggttaaattaaggatcttgagatggggggattatcctggattattggatgggcccaaattaatcacgtgagcccttaaaaagcagagaacctttcctagctggggtcacaaagatgcagcagaagagagtcagagagatgaaagatgaaaaggacacaccttaccgttgctggctttgaagatggaagggaccatgagccagggaatgagtgtggcctctagaagctgagaatgaccgggtctgatagtcaataaggagacggaggcctcagacctcatcaaagaactgaattctgctacccacttgcacaagcctgaaaatgaattcttctctagagtctttagaaaagagcttagctcagccaatacattgattttactgagatccacatcaaactcctctcttacagaactgtgagacaatatatgtgagataatacatgtgttatgtacaagtgctacatttgtagtaattatttataacagcaataggccactgattctcagcatagctctcaacatcccctgcaccccgttaattctgagacattattcttcataaatcatagcaaaaacctagtaatgaagatttttaggaagaagaaataccactcccttaaattgaaggtaacatgcattctggtttttaaaataataaaatgtagacagaaaataagataaattaaagtctttatctttgatttaaggacatatggtatttattggtggctaaacatagggagtttccaatggtggccaaatatagggagtatccaagtttatatcaaaacatctgtgttcctagttcttttaaaaatatgtctcacatctattcatattctgttccccgaaatttccccctttctgaaatgccgacataattagaagacagttaatattggctcccttccctctgtgtgcactagcgttaaatgttcagagcccaacaaggtttactactgtgcatttcattccataatacattccttacacacaggaagaacactggtgacttaaaacagagttaacacattctaaagaatttccagattattaaaaggaatggccctcttgtgattagcagtaattctcaaaattatagcttgtaaccatgtcagactagcacgagagctgttattggacaaatgcattggttgtggttctagcatagaaatgaaatagacaattcatctagtcattttagcaagagttgccagaacaacttcttcttcaaagtcaaaccttctacaattggagtttgaagtgtcaactcttaccataagctggtaatgaatgattttaatccggtgtgtgtgagtgtgtgtgtgtgtgcgtgtgcacgcatgcacgcttgcatctgtgtgtttactgtgtatgccttgtatgcctggcaagaatctgcaaaagttgcatggtggaaaatgcgaagaaaatggaggaagggctttatcttctcttgccagcaaaattgtaactgagttaggtttaagattttgcaatatggtttcaagaagacattctcaagggcccctgctgaataatgtaagttcagatgctgcttcaatatgaccttttttgcttcaataaatgagaaaaagaggaatagatattcttttctgttggtttcagaagtcagcttgatctgaagccacctcatttacattaaatagtggaatctgggttgtttaatagagtgtggaacagtacagatggtagaactccagaaagtttttgctcccactgctgatgggtctagttagacttcctagagaaacatcaggtggtttatttttgacatactgccttttaagaatctctctttttttcactctgtgctgtcctagctctaacagaccagcctcattacaatatgtgctctctaacctgtcttctgtctttaagattaagatacctgaagaaataaatctctaaaagtcttagctcagtgctgccatggcttcagattttgtttaacatagagcaatctgtgtggcccacccataatgccagctctgagttaatgggagagttacaaagggtagattagactcttcagggggactgtggtagttcacacattggacatccagaatttcaactatttgtagaaagcttgtttttttctgtcatgcctgatgagcaagatgcccagtgtttacacaagcatttcaagcacctataaaaatgtttacatcctggaacaaagtattgcctccaaaatacaaaaagggaactataaaatttaaatgaataataatcttaaaatcaagacgtacataatctttgtgaaagtggattttatttcttaaaaattaatctgctaatcccagctactcaggaggctgaggcgggagaatcgcttgaacccgggaggtggaggttgcggtgagccaagatggccccactgcactccagcctgggtgacagagcaaaactctatctcaaaaaaaaaaaaaaaaagataataataataagaatgagctatgtgggtatgtccaaagttcagatttccagaagctagccttgagatgagaactggtgtgcaagttacttaacaaagaagtatgctggctgggcgtggtggctcactcctgtaatgccagcactttgagaggccgaggggggcggatgacttgaggtcagaagtccaagaccagcctggccaacatggtgaaaccccatctctactaaaaatacaaaaattagccgggcgtgttggcacacgcatgtaatcccagctacgggaggctgagacagaggaatcgcttgaacccaggaggcagaggttgcagtgagccgagattgcgcccctgcactccagcccgggcgacagagcgagaccccgtctcaaaaacaaaaaacaaaaacaaaaagacaccaaagaagtatgcggataactccgtaaggcagtgggtgaagcaggtgagggaaaccaagcaagggtgtagtttcagatacagtcctgcagaggctgactctggagtgtgagttgggcttcagagttggccccacccaaagcaaaagagctggattccatccatccctctcaacttcgtgcagctgtgaatcatcggtcaagggtcctccctgggggtggagaggaactaagttccaaggcacggcagtgtttctgagctacaagcatcgggtttttagcagccacattggcaagaggagaatcttcggggctcctgtgagaggacctagcattgtcctctaaagactgctcccgggaggctgaggcaggagaattgcttgaacccaggagacgaaggttgcagtgagctgatatcgcgacgttgcactccagcctgggtaacaagagcgaaactccgtctttaaaaacaaaaagtctgttcctgatggtcattccttgcaacgggttagggcacgctcctaatccatgactccagccactggatagagacacagcagcacagctaatgcctcaactccagtcactcctgattggttccgtagccattcctttggagttctgctgtctgtgtcttccctgcctcaaagcttggctctgtccattggtaaaaggatgactttacctcctatgaatgcaaattgttttcatccataagatgtaaataagaatagttgccttacaagattataagaggattaaattagatgcttcagtaaagtcatctgcatatagtaaatcttcaaggtgtattaaataccttctgtcttaccaaagattttaagggaactaaaaagtgcatacctgccttaaggagttcttttttattatcgctcgaaatacgatactgtttcttggttttagttggctctctcttgccataagttaatgttacttatcctcttcctcctcctcctcctcttcctcttccttcttcctcttccttctccttctttctccctttcctctttctctactcattccaatttttctccttctactccttttctttctttttttctaattcttcttcatcatctttgtcttcttgtaattctaatttttttctaattccaatttttcttcttcaatttctctgcctcctcctattcctgctccttctcccctttttttctgtagatacatgcaaacgttttccatagcctttaagagaaacttagctgcgttgcagcctgtctggaaattccttaagtgtagccagacggatctcccacatgactgcattcgtcacacatagcaggcaactgggaagtgttgagtctggaggtggaggaaagtggttggattgagatccctctttgccaagtgccagcctgtttgactctcatgaacatttctgaatgtcaacctctccatctgtaacattttaacaatgatgccaaccaacattgtagagctgtttcaacgtaagggagatatatggaaaactggctggcttaccatgtgacattgattaataaataatgaatcatggaaggaattacacttgtgccaccagtgtatagggaacacctgctatatgccaggcaatttgccaagtactggctgtatcaagaaagccatcttcgcctgtaatcccagcactttgggaggcgaagatgggcggatcacctgaggtcgggagttcgagaccagcctgaccaacatggaaaaaccccgtctctactaaaaatacaaaaattagccaggtgtggtggtgcatgcctgtaatcccagctagttgggaggctgaggaaggagaatcgcttgaacccaggaagcagaggttgtggtgagccgagattgcgccattgcactccagcctgggcaacaagagtgaaactcagtttcaaaaaacaaacaaaaaaaaaagccatcttctctgatgagccttttacatcttttatgaagaaaatgttttcagtgtagcctcagaattatctggtagatttgttttctaccagagagtgatgagataacctgaaagcttttggatcctaaaccacagccaccaaaatacatattctctttccttttgggggacctgaaatagatttgtgtcattatgtcattctcattcttgtcatgttatgcacaaaatcagcctcttgacgcactcactcttttcttatggttttagaacacatctagatatctttgatccatagacaccatccttgtcataattttttcctgcttatgttttcagaacaactgttctagacaacttattttcttttgccatatttttgaacattcagaacgagtatactcacatttcttctcttgcttctggtgacccagatcttgccctcagctggaaagctgtcatgccctgtgtttctattttgaaatatgtaccttgtttactggatcatatttgtcagagaaagtgtatcagcacaaacatttcaaaatctgcactcattattctgtagaactgagataacttttgtctgcttcattcatttgttgatgactcaaactcatttattggcaaacattatttgaatgagtttcctattagtctctcttaaagaatattaacaataatgatatgcaaaagtcaatattctttactacacagacaaactgaatttctcaacccacttgacagtttaaaattgccattaggaagaatttgactttcaaggagaattaaatggcatttattgtggtgactgattatcagcataagaaccatgcatttttctgctacagtagaggaaataatttaattagtctgttattgtaaatgttctgattttaatacattaacttgtggcctgcagctgatagaaaagaaattaacactgactctttttgactgtggaatgaattggattttccagggcaagaaaattaattataaatgctctctatttaagattgccagattttttatgataaatgatgtaattatgagatgtcaagtatacaaatagtcatgcatcgacatttcagcttattaattccaacattcaccattgcgtatgacatattcttcacatttaattgctcagtagaggggaggcaaaatcattgttctcctcattttccttgtgattttcaggcagtacatttcagaagacgttgaatgctaatgcattaaatttctgatgacagcctcatgttgcattttgagctaagaccaaaataaataaaattcaggataaagtaggataaggcaacagaaggaggaacaaagctttacaaaatggcaagttgggtgaagtttgtcttcagctccctctcatctctctgtttcccttcctctcttctacccattctggggtgtgtgaatgagtccttggtgccttgatggcgaattctagggtctcaggagcttccacctttcccggaaatgctctccttctctcattgatcagtgtccctgttcattctgttacagcatgaatacaattgaacagcatcggaagaattcagggccactcccctgtggccacagttatgagtcacagttgataaggtacataatcttaaaaatcctgcagtacctttaaaaataagtttgtattttgttcatcccacctgtgatgttcagttttacaagtcaatgcagttaggctacagttcccagttatccaatcaaacaccaatctaggtgttgctattttggtatagcaaaaggtgttttgtagttgtggttaaagtctgtaatcagctgactttaagtaagggaggtgatcctggactatttgcatggaccagtataatcacaggggtcctcattagagggaggcaagtgggtcagagtcagaaaaagaagacataatgatgggggcggagattgaagtgatgccctttgtgaaaataaattcatcaaattgaagctgttggaatgttaaattattttgaggcttgaaggaatgtgattgtgagatctgagtcatgcagccagcagctgtaacctttgcttcaccgatgataaattaaccctcttcctaagttttccttgttttgtaaaatgttgtgaaagagtaaatggcaccagagagaagaccccttcactcttaattactaaccttttattatagattaactgccttctttcttttcttgcacacaactcagaccagatggtgcaaaatatcccgtggctatcaaattgcttaagacagaatttttttaaattaaaaaattattttttttagagacagagtctcattctgtagctcagtgcaggggtgtgatcacagctcactgcaaccttgaactcctaggctcaagtaatcctacttcagcctctcgagtagctgggactacaggcacaagccaccatgtctggcttaatgtggactattaaatatgcctttccttaaaaggaataagctgtaacaaatcaaaattactgcaactcataacccagtcttatgtgaaagtgttgtaatcatggtaaacttctttgtatttatctaaatgagtgtgaaaccctgacctctccacctctgagcactgactccactcctttggagtttgtatttcccaagaggacaaattcgaactttgctcttgaataaactctttaaatttggattctgatccctttgtttatttcaggttaacacctttgatggtggaggaaggagctgccgggcaaggaacatgggtagtccctagtggttggaaagacatggaaaagcagattcttacctggagcctccaggaagaaccagccctgccaaagttaggtttcaactcattgagacccatttcagacttcttacccccagaattgtagagtgagaaatttgagttgttttgagccactaagtgtgtggtaatttgttactgcagcaatagaaaactcatataccataagatacctctgaaaattatgcaagtgtgtaaaatctactatttattcaatctacaaaaactgctttgatgcctatatgcatgcaaatccttcttgcaataactctgctacacctctagaggcacagtccgtaggttgataccattgaccaaaacagacaagtgtgggccaggcaacacctcccatcagtccctgctgcactttcccttctagcccttggtagagtctcacgatccttctccaggcagccatgtccaggctttcaagatgaaacctatcagctttccccatcagacctgtatctcattttccccctttttgttacctgaggcaggcagaattctaagatgcaccctaagattcccagcccctggcatatataccctatgtaatcccctctctttgaggataggcagtaccagtaaatatgatggatgccactccagtgattccatccctaatcagctcgcactgaattaatcaaaaggaagatcatctgggtgggactgatcaagccagctgagcccttaaaagtgacaagaagtagcagcagaagctgttctacttaacaaagaaagcaaacagccatgttgtaaactgcttatggggaccatgtggcaagaagcgtcaggcagctactagctgaataaggccttgggagatgaccagcaggaaaggagaaacctcaaacacacagctagagggaaatgcgttctgccaacaacgctgtgagctgagaatgaaactgtgagcatgattacgagaaagggacacagtccagctgacatcttggtttcaacctggtgagaagtgaacagagagcccaggtaacccattcccagatgcctgactcgtggaaactgtgagacagcaattggtgttgctgtaagccactaagttggtggtcatttgtcatgcagcaatagcaaataatacaccatcttgcaaaaagcatatacttcagtttgcaaccaccaaatgcacaaaattaatgtaaactatgttattaattttttataaccatacatgtgctacagaataagagaaatgcttttctaaaatgaaaagaagttgtagtctgagcagaatgggtggttggaagagatgcttccctttaaagtaaccttcccttccaatcccttcccataattcctacttgctcacttggaatgctagatcagctcaggtagcaaggagatattccaggctttctagattactgctattcatgctggcttccaaatcctgtcgtttccacgaccttgggggtctttgtcactcactggaccttctacgcaacggcaaatggaacttttgctttatcctcctaaatcgtaatcctattgcatatttccacactgtttttttttcctcctcattccaaagcatataccagatggtaaatcccaggaaacatttagcaagtttggcaaaaattctgtgagcaaaactattttgaaagctatattcgaagcagaaaaagtggagcaaaggagatagagatagattcagtgcttggggctgatgaaatagtgttaaatgaagcacaaagaaagctttacagttctttattattgtatcttgaatgtgtaggtgaataatcctcagagtggatatagaggaaaacatgagtcagaggaaactaaagtccactagaagtgaacgtaaaggagtattagattgcttcaaagaaattacgcctatgctcagactgagtctatcacagcttatcaggaagatttgaagacatgaacatagacacaccctcaggaaaccagagggaggccgggcatggcggctcacacttgtaatcccaacactttgggaggacgaggcaggagaattgcttgagcccaagagttcaataccagcctgggcaacatggcaagactgtcactacagaaaatacaaaagaaaaaaaaagaaagaaaaactgagagagatagataggggtgaaactgtagactcaggcaaacaccccagttttccaaaaggggatgaagaaggttatgttcaagaaactacccacttttttacatcacactaattcctggttacattttaaataaataatggaaatgtactatcatgtccttaattactatgctaccagaaagaaagatcctagtagaaccatccacgtagccaaatatgcatccattcattcagaaattacctagatagcatataagtactgtaagtactcatatagcaattactaccaaagacagggactatgataggcacctattagatcatggtaaataaaagaggatgctttgatatttatctctctcacagagccttctagttagggtatgtgtgcaaaagttgtgatcattactattacagaaaagcaaacaggataattagaagatctcacataggagataaatttccttgtctgagaacattgtagaaggcttcctcaagtgttagaaggtcctccttctctttaggattccttaaaagaactggtttccaaatgagaataaaaaatatatatattttttggtggccaagccagtgcttaataatctattgaattcatgcttctctggtgaaagctagattggagacatggcctaggatggttgcccaagtgtgacccccaagccctctctgctgaattgaatatgagttggaccatccagcaccactaacctgcagagcccagtcaagcaggctggatatgctggaagagggagctctggggctgacggggatgctcctccaagcccagctctgggcacttctctaggaggcccttctgctcctctttctaggaacaaggaatagaggaaagcctggcccttatacagaaccatgaagaaagaaaaagggaatgcgaagaaaagataaaacagaacaagcccgcccttggcacatatggtcccatgctgcagaagggctcccctcctctcccttgccccatctgttgctcattgctctatgtctacattcattggagactgcagctttgggaaggcaatgaatggggcaggaagaatcctgacagatcatgcacatctagtatggacctgcatctggtgtgggcctcattgatggaagtaaggagaggggtgtcagagacaaaagcaggcccttcacagtgcaggctggggacacgctatttcatgtattccatcaatatatgtataaaagttatctgtagaaacagaaccaataatagatagataggtaggtaggtaggtaggtaggtaggtaggtaggtggacagatgataggtagatagataggatacatggatagatagataaatgatagatagatagatgacagatacatagatggtagatatagatatactgattgattttaaagaattggttcatccagtttgaggcgatgataagttggaaatcttcagggcaagttggcagtctggagattcaggtaagattggatgttgcagtcatgagtttgaaaattagaaactgtgcagaatttccctgttgcagcagaattcctttttctttgggagacctcagtcattgctcttaaggccttcaagcaaatgaataaggttggagggttacatattggagggtaatctgattcacttaaactcaaatgcttcaaatgtaatcatgtctaaaaaacaccttcacagcaacatctagacttgtgtttggccaaacagctggtcaagcccagctgacacatgcaactggccattgcaataaaaccaaagtcagccacaaggggaaagacagaccctaccctgagatatttcagcagatccacacaagatgatggaggaaatagggccaggggaagtgcacattccctcttccagctactcatcataaaataataattcagctgctcaatcagtatttactgagatctaagatgagctaggaactgtcctgggtgcttcagacacagaagtgaacgaaacagaaaagctccttgccttcaaggagttcacagtcaagaccaggggtcagtgaactataaccgacagcaggtctggcctgctgcttgtttttgcaaataaagttttatctggatagagccatgcccactcgtttacatgttttgattgcttttatgctacatcagcagagttgaataaccgcaacagcaaagcctaaaatatttcctctctggccctttacagataaagtttgccaatccctggtgcaggtctttgcatagcaggtcagtgaagcctaagggactcccttttttcattctgttgacaaattccaaagatagattgattgcttcttcagaaataagaaaagagaaaatgaacatggagcttttaaaatctcaagaaaggaaacttctagtagcaaaagtgcttactatagaaatagaacaaaatgtttaagaattacatctcctactagaatcaagaggctcctgggacaaacaggcagaaagtccccaagaagagaacaagtgaaaatggaaaacataacagagtgagatgcaaataccagtggaagtgaaaacataaactcaaagatagaggccatatcgctttcaaggaaaccaaaattacaaaagcagaattaaaacctgcactggatagcaaaagatccaaactggcatagagaaaaagctaaatcaatgaaatagataacgagatactctaaggattcagagaaaaagaacaaaacacatgaaaaatacaggataggaacagagattgggtataaagaaattgattttctctggaagctaccagaataattgaaaaagaagcaattacagcttttattatgtaactattatgccctaggtattgcagtaagcactttacattcattatcaattttcttgattgcaacaatcctttgagacacaaactaatttatccattttttaagtaaaaaatgtaaagagtatgggaagcctgtaaattacccatagttagctactcaacagataaaccagaaatcaaatcccgggctgactaaacttaacacctgacattccatacccctaatgaaagaaacaaacagtgaaaattttaccgaaggaaaaaaaaatgacccaactttgtagatcagtatgattgaccctcatcgtgtaccaagcaaagtaatgatgagtgatttaggtgcacaaacatgtcactgttttgcaaaacaaggaaaggtcctctacatttagggatgattacagacaccctagaagacaataatatggtgagcaaaacccacgaatgcattttcaggctacaccaacaagaatgaattgtttggttgaaagaaaggcaatgatattctacacctgtcaagccacatctagaataaggtccagtctaggagccatttttaaggactttcataagccttcaaacttagaaagcaaccagctggactcatctttgggaagtgttcaagggaagcgtgcaggcagatgttgatcacacctcaagaggagaaaaccatccaggcagtggtgggggatacgtgagcgggtgagggctcaggtacctttcactgaagacattccaggaacttactgctccaactgatgtttgacttgggctatacatgcacaaagcaggattcaatcgtcttttattgttgcataaacaaggttcaaatgacttcctgggcagtgaaagcaagctcatgcttgacatattggaggaagtactatttcattgtttttgttttatcacagttctgtggcttaaagaatagctgggctattgcattcattattgtcatttgggaattattattttacaaactcggcagaaaaacatgatcatagtctaaagatagctgtctaaagccactctgaattgtcccttgaagggtttttggatgcttatgacagctgagtaaaagcttagtcccaataaaaatgagcttttaagaggacaagagtagccaaaagaaacaaataaatatgcaggacacagtttcataatttgtgctgctcttgaattagtaatacagaataatcgaatggaatacattataagttttattcagaacatgctaaaataataactattttatgagtacccattaatgtcaattattattcattattaatacttcaccaccaaattaaaaagatatgtctgtgctgcattctcctacacttgtttctttcccgggtattatgataagactcaattgctttataactaattaatgatctaatgcaacttggaaataaaaattgaaatctaaataccagatattaaagttgatatgggatgacattcttttgtgctctcacgttgtttatcaaattttgattagtggtaaatatttgatattcttcctaagatcttctttcaagttccaagtagtttttttttttttgcgggggggtgtggaagttggggggaaatcactcctttgtctttattaaagaaacttagaaagagaccagacctggcaaccaaggggtgaggtactggccaggaaggtggagtgggctcaggctctgtggatttcaagtgcagactgacggcctgggagaggccaaggagaccagatcctggcagcagctgaggaggtgcccaagggcactttcaggcactggggccttcagtttgttctgtgggcaagggttgggggttgggatgcagggtaggttgggctggcctggaatctccctgagggcaccctgccttatctacctagatcattcactggtccacatcctgttcgtttccttcatgtccacctcattgacctctccgtcatcaggtgacccattgtagtcattcatcttgtccatgtcctgcatgtcctcatcatcctctaagtcctcttcactatcctcattgtcttcatcatcctcctcttcctcatcatcatagtgctctgaggctggcttgccaataggaaccagattgttgtctttctctgtgatgctttcgagccaggtctgatgctgctgttcctgctgctgcagctctgtctctcccatacaaggtcgatccagattaaaccacagtgtctcagtcccacaaaggaagagtgagggaaacaaagtggacatggttcctagactgggtttgagtcctggctccactacttactagctgtttgaccttggccgagtcacttaacctctctgggcctcagtgtcctcctcgcaccagggtctgcagccagtggagacccggaagcgcttcaccaagcctgagtggaagaacccaccagaatccgggactcacccccaagcagttttatgtgatcatctaatcctgttattctgattttgaaaaagagagacaactcagcagagccgttaatgtcaaagcttttgcttatttcaatatattaatctaatgggaaatgctctagaaagttgtagatattcatgtccctgcaaacagttgcatcacatctaagatctttctcaggggacgaacgtgaatttcttattaaagtatttcctcttgaaacccagagggtaaaagttctatatatttggatacatagattttaaaaagtgttggtattctcccttaaacctcacaaaagtcctacagagtagctacctttcattaccttattagagataagaaaattgagacttgaacatttagtgagttttccaaaggctaacagttcaaattgcagatccaggcccgaaaacactggcaagattcacttcactctaccctgctgaagctgttacccaacagaaggattagaagatctaaccccacccaaatgatttcttagcttccttctcagaggtaagtatggagagtaacactcaagttgattaggaaatttaagatgcgctttatgtaattttcctttggaaggctaccttttcccagcctcacaaacatgagaagattatttgataggttatgctgggtgaatatgggacttgtgtctgaaatggctttgttcctttctcagaaggtaacatagtgcattgcatgaaatagacatttgataatacaggttatgtggacaaatttttgtagctgaacctctatttacaggatgtgttgacgattgttgagtgtccttctatggactcctagctgtacagtgctaacaaataaaatttgtccatctaatccatttagtttagcaagtgatcaatggaatgaaaaaagtcaaactgattgactaattttactaagtaaccaaactacttctcttttcagttcagcaacctgtcagttcactttaaccctttggctcctgagtgatgcagacatgagtctctgctctacagacaaggacttagtctaatagcccactccgctttagggcccaggcttgcgatggaaaaacagcaatttgccctccttcggacattttgataaatcataaacatattcatccccaaacctcgaaattattgctggaattttttttaagctagcaacacaaaattcgagttctacattcatcaaattcaaggcacaaaacctcatagaattataaagtccacccaatcaatggaattcagagctaagaattcagccactaaatggcatgattgctgtaattagtcgaatggtataattatagtaaacacatgataagttgccactgaagcacataattgcacagtataatggtattattatgatttctgatgatataatatgatttggatgtataacaaattcccataacaatattaaaacatttttcatttgtgcattttcttagtacctgatttggattttttacattatgggagtttaagtcaaagacaggaaatcagaccacgttttcaacgaaagaaaaagaagttattattcaacataataccttgttgagaatgtggttagaaagagataaaggacttaaagtatgaagtcagtcattaggataaccctaaacaggtattatggttataattcaagaaaacacctttacaaacatgaatgttatttcatatctattctatgttccaggaattaatcattttactttgaggttaccatgaaaataagctttcccaggtcacaacactgtccacactatctttgttttttgtttgtttgttttgagatggagtttcgctcttgttgcccagtctggagtgcaatggtgctatcgtggctcactgcaacctccgcctccctggttcaagcgattctcctgcctccgcctcccgagtagctaggattacaggcacccaccatcacacccagctaatattttttatttttagtagagatggggtttcaccatgttggccaggctggtcttgagctccagacctcagatgagccacctgcctcggcctcccaaagtgctgggattacagatgtgagccactgtgcccagcctatctttggttttaacttccctaggagaagacaatgttttcaagccatgtgcacattggttatatatgtattgttgtcccaaattctttttagatgtagattttgtatgatcaaaaacatttttatttcatagaatttgggaattggaagaattcttagagagttgagatgcatagttcaggaattcatggacttatttcattgaaggtgctaggtgtataagtggaagtacattcttcttggaaagggatttttatcatggtcattagtggagctgtgaagccagaaaggtctacctgggagattctaccatccgtctctactggggctgaaatcttctccacaaatgcccatcaggtctttattccacttcagcttcaaccttcatagtaaggaggctctaactaatctgtacagtagaaaccatgagttctctgcctaccaacctgctaatacagtttaactttcttttttaaacaatgaagcataatgtttctttctattaaggctacagttcacaaaacctcctagccacacattgtttaacagaacttcccatgataatggaaaattctctacctgcactgttcagtgaagtagccactagccatatgtggctgtggagcacttgaaatgtggatgatgcatcttagggactgaatcttttatttaacttaatggtaattaatttatatttaaatttaaataaccataagggtggttaccatattgaacagcacagccctgcacattgtttttctaggcaggttcctcttcaacactattttactcacttatggcactgtacattacattttatcaatttacacatgcagtattatattatcacctaagcaaatatacagcattaagcatcataaaagttcaataaatattaatggttatcaataaatggaatcattacagacaatgaaatagcacgacaaaatataagaggtaattagaatcagtcttgcttttattgacaaagacagtccatggaactgggagccatgatcacatcatggtataggttttcacgatttccaattattttgatgaatttcacacttgatatttatctaaagttaattcaagattttcttatttgaactttccctgccatgaatattgatgggttttactgtagtgtgaatttccaagtgtctttcttttcttgtaccctgaagattcagattttaggatgcattgtttattgcttaatttcattgcacctctagagaaaggaggagagatcatttcatcctaaagcttgctatgagaaagataagacacagaatacagaatcacaaaggaattaagaattccatcctgctagaaagtaaagtccatgaactgggaactcaattattattttgaataacagttcaaaatttgcataagaaatgtatattttgaatgcattttttcccataaaaactgctcttgacttagagatacaagaattaactaaaacgcagatcctgccccacgtaagaccaggcaggagaggtgctcagagctggagcttagagttaatgacagggagctaatctctgtcccaagagcaataggaaccaacagtaagactatcaaggacagggtggggaagtggaggtagaacatgactcacttggcatgttgaaaatgatctttctagctatatggggacagggactggagggccaaacgttttcatgctttctgctcattgtccaggcgggaaggaactgcacattgccccagagagatcagagcgcagatgaaagacttggttgtacttgaggaatattcagaagttggcagggcttggagaaggaatgtgagtaacgaggaagatgctcaccacggatgccgccaggtttctggtgtgaactgtgctgtggagctgccactcgctgtgagcagagccgttggcattctcaacagggcagagatgagtgttcaagggagctggaagttgcagaaccaagccagcgctggagaaccaagtgttcattgttgtggagtaaagcaatctttccagaatcacaaaggtgtcaaaaatacaggaagagcttcgtttagttttggggtgtgtgtgtgtgtgtgtgtgtgtgtgtgtgtgtgtgtgtattaaacacaagatacacgataaatcctaatcattcattttctgctttttgggggtttgttcagtttgctgatggcacttagcctgtgcctctctctgagaaactacgttgtccatggcttacacaattatcaagttcacgatagaagctgcctggcggacatgcctccaactgtgtcccatggcatacagcgagtgcttcgcaaatgctcccagctgaacataagcaatgcccccacagactctacaatctctgttgccttgtaatgaaaacagcacacaactgcattccctgggttccaagtgttttgctttttcatagaggatgtcctcaatccctcaccctgagccaggtcaatgtgacttgaccatgtggatgagcttcttaggactgccgtaacaaagagccacaaattgggtggcttcaaacaacagaaatgtattgtcttgtagttctggaggctaggagtccaaaattaaggtgtcagtgggaccacattgcctctgaaagccttgaggaagcctccttccttgcctctttcaactcctggaagtgaccatcaatatttggcatcccttggcttgaaactgctttgattcacactctacctccactgtccatggcattctccctttgtgtctctgtggctaaatgaccctcatcaattacatacaccagtcattggattacagcccattttaattacctcatcttagcatgacggtgtctgcaaagaggctcattctaaataagacacatgcaccaggggttaggacctgaacattgctttttgggagacacaattccataccgtgcattaaaattttctaactggagtatttgtggatatttcccatctactgtcttccctataagtcttggtatgaaagaaagaaaaatagggagacatattcagcctaattctggccacctctagtgctttgtccatgatttcatcagcacttacctgattataacaattatttgattatgtgtctgcccccacccctgtcttggaaatgagatctttcaggacacgggtcagtaaataagacctgtgtgtcatttattacataagacatgtaagacataggtcttattctagcttagtgcctaatacctgtcacactgagggacctcagtaagcatttgtcaaatgagagaaggagagagaagaggagagaagaagggaaaggaacttgagtgattttctggtttcatgtcgagtcttcagtcttaaccagattaactcaccttcctcatcagccctttctaattgcctccattaatttccctcactagccttgcaaagattgaaactcattatcagacattactgaga

SEQ ID NO: 262 - DNA, 476826 bp, Homo sapiens
acggcctttatctctgtagcactttctagttgatattgtgcttttccatatattccgtatattcatgtaatccctacatacactttctaggtagatcactggagcggtcagtccagtggggaggctaggagtgcagacctggagccacgctccctgggtttgtgtccagctctgccacttcccagctgggtgacctcgggcgtgtggctgactccctcttgtgcttcaacagcacctacttcagaagggtgttgcaaggattgaataagttaattcatgtaaagttctaagaactggcacataaaaaatgttgattaatattagctattactataaattatttttaaagcttctcatcctttgatgttttcaaaaatgaatacctaatttcagagggattgtatgtgaagtccatatttcactgtttttaaatgtttccctgcctcccccaccctgcctctggttccaccctgtcccggtccctcttcctagtgctgcccagactgggtcaccaaacaggcctgtctgacggaacccttgtcacctttgtggagaattctctttgggccctgcctggaagtaagagccacggagcctgcccaggtgccccttctcctcctttccccatgacctgggcttctgcattccctgcagcagtggagatgtggtgtggctaccatgcttcccccgagctctgtgcctgctgccccattctgctcaggagcctcttcctgcggggaccctctggtgctctggcctcacctctgtggctcgtcctctctgatgcctcctcctccccagagagggcgttcatctctggtcccatgctcctctgttagtctccactagtcaaaggcagaggtgatgtttcccgcctccctgtaatcccagcacctagtagcgtgcccagcaagtgaatctctttgtcaggtagttaagacagtggattaatatgaaataaaaatatccctttggcgattcttttggtcacactgtgttatctcctccaggcaggaaaaatactattgtattacaaggctcggaccaaagacatcctgattcgattcactgcttggtgttgtattcttgtaagtaagcagcattcctcgctaaaattcctttccttcacatgtatagatatttaaaaggaataaaatgtttagcaacactgagctagccattgtcaccacatggcagcaggtaccattttcttcacttgaataacagagaggaacaaatctttccacctaaatgcacagatttattttcttaggaaaatgtctttatcaataaggcagtgtttgccatcagatagccaggaatgcctgaagaaatgtgaggtatgggctctgtgtggagaggcgtatcagagagactgggcaaatcagaccaggttgcagacatcaacttccagattatatgggaaagagagttgcaaggttgactgtttgttcatttcatcctgaccgcagccatgcctcctcttcagagtcactgtcatttaatcagtaagcttaccctcttcaactcagtagaatggtgaagagattttgggagagtatttttcagttcatacatttaaaaaaatatgtttccatttaaaagagaaaaatataaggcacaagtttcagccctctctacgtgattaaataactaatatatattggtgttgaaaccaagtgttttctgagataataatataaaatgttaacatccttctcttccccattacaggggctcatttctgttgctctgacgaaggtttctgaaaatgaaggctttattccagtaaacaaaaatctctggtatgtatggaaaaagcatgattttatggatgactgttcatgctgaaattggatttgttccgtacgagcactgaaacgtctcctccacccctcccaggtccctttcgtatgtcactacgctcagttcttttgccttcttcatcctgctggtcctgtacccagttgtggatgtgaaggggctgtggacaggaaccccattcttttatccaggtaagtcacctccaacctcaaacagagctgggatggtgaccaggaggcaggcccagggacctctggagcatccttggtgctggggtcttgagccactgccctagcggcaggtgtccaaaagccaggctgagggaggaagcagcagggcccacattgtcccagcccacaccagatgtcactggcctgctccagagcagtccaccccattttcaccgtgtaggttgtggagtcgttgtatgacagtttgtgactccacctgtttcttcaggctataccaaattgtggaggagcggaaatgattcagggcacattatccagtttctggttctttttttttttttttttttttttttgagacagagtcttgctctgttgcccaggctggagtgcagtggtgtgatctcggctcactgcaagctccgcttcccaggttcacgccattctcctgcctcagcctcctgagtagctgggactacaggcgcccgccaccacgcccagctaattttttgtatttttagttgagatgggatttcacagtgttagctaggatggtcttgatctcccgacctcgtgatccgcccgcctcggcctcccaaagtgctgggattacaggcgtgagccaccgtgcccagcctctggttcttaataatggtgctatgcttgctttcttaatataaatccactactatagagattgtgcattagaagaaatagcaagaggtgatatcaagggataaatggaatgatttagatgcagttccaaccgaggacttagaaacacatcagatcatttcaatgcctcatttcagccctttgattcgaggaatagttacattctttggacctcagattttctgcctagaaaatataagttattaataataattttagctttcctttcagatttagttttcaagaattgtactgttataaaatgaatattatctaataccttttttgtgtttttgagacacagtcttgctctgtcgcccaggctggagtgcagtggtgtgattttggctcactgcaacctccgcctcccaggttcaagtgattcttgtgcctcagcctcccaagaagctgggattacgggcacaccccaccacgcccggctaattttgtatttttagtagagacggggtttcatcacgttggccaggctggtctcgaactcctggccttaagcgatccacccgctttggcctcccaaagtgctgggattatagtcgtgagccactacaccaggcctttcaataatttttgatatggtttatatttaaatacctaagatatgcattacttatttttggcagtagccaacaatggaagtgcacactttctgttttttcattgaactggtttcaagaattaaatagatggttagatgtgactcatctgtgagaaacatgatcttctgtatgtctctctccttaaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaataaatagtagtgaaaacttttaaaaactctcattggagtaagtcttttcaagatgatcctccacaatggaggcagcgttcctacttgtcatcacacagctgaagacattgtttcttaggtgtgaaatcggggacaaaggacaaacagagacacacggcattgttcatgggaggcatcgtcaccctcctgggtgttctgtgggaatttcctgtgtgaggaaaacgtggccacagggttgtgctgtacccacccttccccggcgagatggccctcggcctgtgccgctgcttccaccctcgccactccatggcagcttttggtctgtttccggctctgccctctgccctgaactctcatccggcttgtacctgcctgctggacccctccacctggaggccagcccatgtctcaggcccagccctagcctcttctcctcaaattctaagtgttttctctttaggtttccctggctttgtgaatggatcatgtgtctctaggtataaacctgacatcatctttccacccggcttacctccaccagatctccccagttctgtctccatcttctacctgcagctgctctgttctcatggtcactgctgcatcactgagtctggacccttgttatcattttcaaactggcctccttccctcgttccccacttcttaaagtcacctgtccattgccaccagattaagctttctccagccagatcacctctctctgagaaacctccattgacatggaaacaccattgtctggcacacatactcacatactcaccttcccgtcttgatccccacacatctttccagcctcccctcccactccactccctgctctctcctccacctccccatcctcttgtctcccctcccctctgaatccagcccagcggggcttctcctgcctccatcacatcacagaagtacctcctgcttctggttttaattagagccttccccgattacattttcctctgaattttttcctatctacatttgatctgtcatgtttaaaccccctacttctaagggaacttctctaatctcttatcctcatccccaaatagtgttttcttcctctgggttcttataatgttggtatcaatctcacagcatttagtgcttcctgcctggtgtgacagttacctgtgtgcatgtgcaatttctaatttcccacgctagactgtgagcttcctaaggcaagaatcatgccttgttggtttctgtattcctcatggtgccaaacacagtgccttctacattgcaggcgctgaataaacatttttaaagcaaaatgatgtggatttttaaaataaatatttaagtgctggtaagatgagcatgtatccggggtgcccatgaaatgttcttggggccgtgtggggacagtcgtcattcctcctcctgccacccttttctttcagtgagtcactgtggatggtcccagctgtgtcatcccaaagttcagcagggaaagctgagctgggcctctccaggtgagttttctagaagcatttctcaaactgtgggttacatcaacttgggtgtcttgagctgtaaggaaggaactccggagtcagctgggctacaggggagcttctctaagtcctgcgggaggccagacccagcctgagcttgctgttagctagcggaggcagctgctggtggcccaggtgctcgacaccaggcatcccctctcctcccacgaagggtgtgccataatccccttcaacaggaaatgcttcccagaagcctctcagcagcctcccctcctgtcctatcagctagaagcgcctcgcttgtcccaagaccagcagggacagggaactgtccgagcccgtggctgtgtggaggaaggcgacccccagcacaagattggtttcctttgggaagggaagagggagtgtgttggggtaaggggtagagcagaggaatggtcagggggcaacaaccgctgacagctgcaacaggtgcatggcatctcacagggaggcagggaggtgcgagctcctaagtaatggagcaaaaaaattctattctgtagaatggggagagaaaatgtgacattttaatttttttttgcatttatattcctaattcctacttaaagtgaatatactgccgctgtagatcataaaatgtatcttttccatggccaacaaggggcatcttttataaatgcataataacccagtttgtatcaaagggtatcgacttaagtgaaatttcaacatgctgttactttttccttttaatgtaattctgttttccaaataaatgggggagacaaatggactttgagtaaatttcttagcatatcaaactgcctttcacaaacagatctttgtatggattctaagaagactaggagtaactgggtgcagtggcgtgtgcctataggcccaggcactcgagaggctaaggtgggaggatcccatgagcttaggagttcgaggctgcagtgagctatgattgcacaactgcattccagcctgggtgacagagcaagactctgtctctaaagaaagaaagcaaaacaaaattagggatagagttttaaaagtgctaagcaatacaccatataatccatgaccctattaataatgaagcttctggcataattccagcttttaaagtctttatcacacctcttggtaagctttgaaattaagtggggaaacttaccagttacatatttgtgtaatctatcagttttcactagaatgtagtaagccagcatttttcttttagtaataggtttctgttgagcattcattttaaaattgttcttcaagctacatgcatttccaaattcaaagtggatggaaatgcttggccaggcgtggtggcttacgcctgtaattcctgcactttggccaaggtgggtggatcacttgaggtcagaagttcgagaccagcctggccaacatggtgaaactgcttctttaccaaaaaatacaaaaagtcaggcatggtggcaggcacctgtaatcccagctactctggaggctaaggcagagaattgcttgaacctgggaggtggaggttgcagtgagctgagatcacggcgctgcactccagcctgggtgacagagcaagactctctcaaaaacaaaaaaaacaaaaacaaaaacaaactaacaaaaaacaaagttaatggaaatgctagatgtttgcattatgccataaaatgcctcggacttcataaatgccttatctaattgtgtttgtcaaaagactgtaataggcaaaatacgccatcacctgctggctgttctttccagaattccatccaaagtgctagatgtgaggacagctgtcttgcccactgtcaggaggagcttgtggcttcccacagtgtccattaccatttgcggttcggtggaatcctactctgactactggaaatttttctgtagaaatcagttctttttctgattttccacctttcatggtcagctgttcttgtattttatcgtatatgtagtcacacctatacttccataaacgagagtttctattctgatatttggtcacagtctgagtgtcatttggctacaaactggtgcctccctctccctacatcctatgcggctctgtccaggtcacagctggttgagcagaggtacagcccggcagtgtgacaaccccaggtgatgctttcctgtcaaaggacactaagaggacactggccactaacactgtcacagcagggaggtgcagcgtgaatggagagcaaagactggagacgtcttaaagggcggggtgcgtcaccgaggaggcactgagcgggatggctgtccttgtgaccacgccacctggattctgttcattggcgttgtccgggggagaaacaaaccgtctgtctttgtaataggaggcagcgatgcaagttgtaggaagacgcccactgaattgtggcttgcacaggcaggagggccctggcgtgaggggtggccagggagagcccagtgagggacgcagctctggggccccgcgcccctggaggttgccccggaggcagggcctcgaccttgacccacagggctgggtggggctgaaaatgggctcccagaccagcgcgaggagctgcgcccaggcctagcaggcggtttggccgcggctgcagcttagcgtctaggccacgccaggcaggctcccggagccgtccactgccccaccaggaacgttccgggctcttctgctgcgcgcggaagcaagtgaaatccagcctcaaagactctgatggaagaacacctgtgaataccgcgccctctaggcgtccgccacaccccacggccccccagacggggtcttcttttgttgcccaggctggagtgcaatggcgcagttatggctcaatgcagcctcgacctccctggctcaagccattctctcgccttagcctcccaggctacaggcgcgccaacacgcctaatttttttaaactttttttttttttttggtctagcgacggggctcactctattgcctagggtggtctcaaactcctggactcaagcgatcctctggcctcggcctctcaaagttctgggatttcaggcatgagccaccgcaccggtccttgagacttttgacctccgtgcccgcccctccggaatgcccaccccagccaaactcctctctctcctccagctggtggctggggcacggccctctccaacacctctgcccctccgctattgaacttcacatccaagtttatgtcacttctctgtgcccaggccatcggatggccccagctgacagtggcatcccgtccctacagtttggggcttcacccatattcacaaaggaccaggggggtaaggacccccaaccaggcacccacgttggtgaaggctccccacttcctccatcagaatccaccgctggggaaccctggccattcgcgggagctcccaatattccccagtaggcgccccgcccaaactacatcccttctctccactagacctgggctactctctgggagaatgaaatggcctctgccagacagggactcacccaggacacaacccctcatcccgttgaacagactgcgtatgtcctctaggctcaaggaaacctgacttgctgggcctggggcccttaggcctgctcttattcagtattcataagaatcagcaaagcgtttcatagagtccacagattcatgcaaaaagaggagaaaagcacaaacacagcagcacacatgcacaagcacacacacacatgcacacacacatgcacacacatacatgaatacacacaagcacaatgcacaaacatacacgtgcaaacacagacaagcacacacaccacacacacaagcatacacatatgcatacatgcacaagcacacacatacatacgcacccaagcacacatgcaaacatgcacacatgcaaatacaagcaaacatgcacaagcatacagatataagcacacacaagcacacacacacaagcacatatacacccaagcacacatacaccaagcacacacacaaacacacgcacaagcacacatgcacaagtgtgtagaaacacacacaaggacatacgcacaagcatgcacatgcataagcacacacaagcacacatgcacaagtgcacacgcacaagtgcacacaagcacacgcataaacatgcacgagtacatacgcacaaatgcacacgtgcaaggacacagacacgagcatacacatacgcacacacacacacaagcccgcatgcacagagaccttcaaggggctcccccccggcccaagaggaagtcattccgacttcctgcctaggtcctgcagccagagcagcagcaaatgccccaggagacggtcctttcaacttcctgcgcccctcggctctctgacaggcccaggccaggccttattatccctcagtgtggagcccagtgcaagcgccatcacctgctggagggagccgggactccgcacccgggcctgcccgtagaagcctcgtgcgctcgtggctttagtgtgcccttttcctccatgcctgcagtaagagctgaggcttgaccaaacattccgtttgtttcgagcattggtaaagagcaggccaaagggcccgaggccccacgttggcggctgccttgggactagcaggcacgctttgcaggatgggtccagtaggtatagagatcgtttgcgttcttggtccatctctgtcattcccctagagagcagggtaggcctagcccccatctctgtcattcccctagagagcagggcaggcctagcccaaggaaggtctattcggccacaggtttgggccacagcccctggtttggcgaaaaggggggtgcatgcggctggcctgggcagaggacataggcaacctttgccgatgggttcctgggccccgggtcctgtccacccgtggtcatatgtggacatgggtgaagctccaaactgtagggatgggatgtaactgccaacaggggtgagaaggtcctgggcggggaccgtgacagaggctcctgtgtgagatgtttgacagtggaggggcaggaagtgatggagggggccgtgttcaggccatctgtaagaggagagagagaggcagctggcagtgggtgtgcagtaggggtggccacagagagcctagaggccccctattcccagacagactcccatccaaatccttggagaaccccattagtacagccgggaggggaaacggtatggaggttcttcaaaaaattaaaaatagaactgtgatatgatccagctgtgctaagtatttatctaaaggatatggattttgcatattgaagagatatctgcattccagtgttcattacagcattgttcataagagccaaccttatgaagtcaacctaagtgttcatgaatgaatgaatgaatccagaaaatgtggtatatattgacaatggaatactagtcagcctttaaaaatagaaaagggaatcctgtcatttgtgacaacatggataaacctggagggcattaactgaaataaactaggtacagaaagacaaatcccacatgatctcacttatgtagaatccaaaaaaggaattcacagaagcagagagtagaatggagattgtcaggggcagacgagttgattgaggagatgtgggtcaaaggatacaaaagtccagttagacaggaggtataaattgaagagctgcatagtgcaacatggtgactagagttaacaacaatgtgtttacgtctgtgaacctgcagagagaagtcacttgagaactgctgagacagtagattttaagtgttctccccacaacaataaaagtttgttaagtgaggattatgtgaattagctggacttaggcattctacaatatatacatatatcaaaacatcacgttgcgcacatacatatatacaatttttatttgtcaattaataaaactttgataacagaacaccattatgatattgactattgaagcttatactttgaaaattttctaatagcaacattgtgtatttacttcatactttatattactgtattcagtttactgggttcttatgaaataaaataatgcagcaaaaacaaaacacatcatcttctttgtacatttctggcaagacatctgcatagtaagtaatttggctttgcccaaagagaggtctggccccttctgttgacttcagggaggtaacccatatcacacctgacagagtgtccttgtgtagagccgggctgaccacactggatctaatggagaggctgcccacacctaacagtctcagggtatggggtgattatgccagaaagaccaatcatgtaacctagggtagtggctttggtcccctgatatgagtttgtttacctgatgactgacttgacccatgtgagaaatcatcagtcagtcagtcatgtctacataggaaagccccggtcagatctctggacagcagagtgtgggtgggcttccctagctaaaaatactcctagtgtgttgttgtgtatccatgcaggtaggctaacacatccggaggacagtggaagctttgcatttataaatctcccagactcagctctgtgggtctcctcctttggctgatatgagtttgtacccttgccctgtaatacactataaccatgagtataatagcttccactgagctctgtgagtccttctgtgaattactgtatctgacagtggttttgtgaacaccccaagcttgcaaaggcagtcttaaggaatgtgccatgagactttgcagtttggctacttctggggagtactcaacagccaatctcctagcatactattattctataatatgcatcaggattaatcaatatgcacttgggcttagctgtaaatttatgaaaaataattaaaatatgtatctggtaaaataaataccagtagctgtatgcattcggccctaactaaatgctaggtactagacaagtattatttgcttggtttatcacaccaacctgtgagatacatagttatgcctaattctaaggaagaagagaaataaaaaatttaaaaaaaacccagttgattagaatgctactcacacactgtgttgggagaatgttattttaacagtatagacatggtgactataacatgtttaaaagctgtttcttagaatgctttctatacactatgttgcaaatagttttatttcagagactggatatggtggtaacacaataatgcctatagtgtaaagacatatttaaagatgtttctgagaaagctatgtacacactatgttgagatcagtgtcatttccaagaatggatgtggtgagcactctgtatgtagcgttaaaagacacatgtttacagatatttctaagaatgctacacgtacactatgttgtcgtagtcttattacacagaacggatatgaaaacccccaagtaatgcatgaggtggatgcagagacacacatttcacagctgtttgtcatcatgtttctcatacaccatgtggagaacagtgttacttcaggtggaggtgaagcccacactctaatgcatgcagagttgggctaaaagacacttgtttaaaagatatttcttacaaggctacttgtacactatgtcgcatacagtgttgtttcaaagaatggatgtgatgaccataaaataatgcctatagcaaagtactaagacacgtgttttaaagctgctttgtggtattctacatacatactatgttaagaacaatgttttggcagtgagtgatgtgatgactgcaccgtaatgcacttaaggaatgcttaaagagaggtattacaggccaggtgtggtggctcatgcctgtaatcccagcactttgggaggttgaggtgggcggatcacctaaggtcaggagtttgagactagcctgaccaacgtggcgaaatcccatctttactaaaaatacaaaaattagctgagtgtggtggtgcatgcctgtaatcccagttatttgggaggctgaggcagaagaatggcttgaatctgggaggcagaggttgcagtgagccgagattgtgccattgcactccagcctgggagacaagagcgaaactccgtctcaaaaaaaaaaaaagacataggtattacagatgtctcttgaatgttactcttacactatgctgacagcagtgttatttcagaaaatgtctgtggtgaccacactccctgaaactaaaacgactagatgaacacactggggaaaatctctatgacattggtctgggtgatagtgttttggatgtgacccccaaaagtacggacaacaaaagaaaaattaagacaaatgggattacatcaaagcaaaaagcttctgcccagcaaaggaaatagagtgatgagataacctaaggaataggagagagtctttgcaaatcaaactcctgaaaaggagctaatatcccatggcttctaccggcatccatgaaaatggcaggttaatatgacgacttacaataggatggaattgaagaagctgcacacttatggaaagttttggtaatgaggctgggatgctgagagatgactttctggcccctttgtaggcctggtaagaggacctgtgaattctcttggccaagtggtgagcaaggtggggatgagtgtcctgcactgtcctgtctgcgaatgtagcgacgagtgggtgagacaggattgaaacaagcagcctgagtactttgcttgttcatgtttctcctgctaggaaaaaggggtaaggggtccccagagctgacactgagccttgaatgaatccaaagcactagaagttgatatggttgatctgtgagtggcaagaggctgctagaaactaaaggaaaatgtgctttgttagtggctttcttaccagcatggaggtgcccattccctctgcactccgtaatcacccatccaccagtatccaacttcagcatcttgaaagattaagccaagtatgaatgggtatttgagagaggagagtaactctttggagataggtgttcagttaaccatcctgtgtagtcccctggagcacacggggagctctgggtgcagggtaggtggaagccccagaggactgtagggtctagagtggtggcaaatgggcagaaaggagtaaattccggatcctgggtgctctccaaatgctgggatgcccacaggggagaaggtagcacaacccttagagaaaaatcccatcacccaaaccctctcctcaccctagccccttctggccccttgtgcctccacacccttgcacaggggatggtgcaatcttaagtcagcccctgactcagacaggtgtgaatcaccatggtctgtgcttactgagctaatgctaagcgtgcttcatggctctctatagtaaatcaaaaatttgtttgggtgacatatgaccaatgagagttctgtaaatatgggtattaatgaacactatgtgacaatgaagccttttgtattatagaagcacatattcaatgaattctaagcacaatcccaatagtacttatctcattcttaggtcatctttgcaaaggaggcaaagccaagccaggtcctgctgctttgactgatggtgggaagaggcggagtgcatgggtcaccaggcagtggggaagagaggaaaccagcgtggattgcacttcactcacccagctctgtcctcctcctctgattgacatgctacaaagctcagtagggtgtggtttcatagcctgggactcaagaatccgggaattatatgaggacccagcccaggtgcgtctttgggaggcacacgtgagtatctggagtatacagaagacagatgcactgtttactcagggcatggtgtgccaagccgtgtgctaacagcaggttataggctctgggtgacttattctttgggctaactcaacaatggaggaactcattatccttattttacatgaggaaactgccgtttagatggaataaataaatagacaggattaaatggctggtaaatggtaaactgatatctcaaagacaggtcatctgatcgtactttaggtgagctaggcagcctcatgccagctctctacgaaaatgccacaagcagcagagggtgtcatttgagcctttgatgaacaggagaaaacctcaaacgttgccactcatgagaatggggttaagattgttacaacatttgacgggacacctatttgtaacttttttttttacttcactgggaaggagggagacacccatttttatcttaatgcagtccatgaaagtgcctgtaaggcttatatgggttcaggccgggcacggtggctcacgcctgtaatcccagcactttgggaggccgaggtgggtggatcacctgaggtcaggagtttgagaccagcctggccaacatggtgaaaccctgtctctactaaaaatataaaaattagccagatgtggtggtgggtgcctgtaatcccagctactcaggaggctgaggcaggagaatcgtttgaacctgggggggtggaggttgcagtgagaggagatcgtaccacttcactccagcctgggggaaagattgaaacaccatctcaaaaaaaaaaaaaaaaaaaagacttacatgggttttgagtctatctcttggataagactttacgtggaatatattttatctcaaaaagcatttattcagccactgataactctatgaagctctgtaaaatatgtaatgattagacggattaggtgtttcatctgagatgagtaactgtgtttgtaataaaatgtatttataaataagtatgatcatgaatatttaataactagtaaccacttgaatacatgtctttggccagaatatttacatatatatgtacctacactatataatacctattatgtataatttttatatatacactttatattatattacaatatagctgcaccttctgtggcttttgtgggctttattacccaccaaggtgtcagccatcaggtcctcaacagtggcagtgaggaaatcaggcgtgcatgggccaagccactgggcacagtggatctcccacgagaggggtccacagagttcagggggtatggcagctctgctcctgctgagagggtgccaggcagcttcctaagcctataggacctctaaaagtctcctttttctagacacaaggtttggtgaatggtgtggctcggatgttatttgtccccaacaaaactcatgttgagctgggtgtggtggctcacacctataatcccagcactttcggagactgagatggggggatcacttgaggtcaggagtttgagacaccagcctggacaacatggcaaaaccctgtctctactaaaaatacaaaaattagcccagcgtggtggtgcgcacctgtagtcccagctactcgggaggctgaggcaggagaattgcttgaacttgggatgtggaggttgcagtgagccaagatcatgccactgcattccagcctgggtgacagagcgagactccatctcagaaacacaaaaataaaaaatctcttgtgaaatttgatgccaatgtggcagggttgggaggtgggccctagtgggggattttaggtcatgggtgtggaccctcataaagaatgccctcttccaggggtgagttctcactgtcattatttcctgcaagggcaggttgttagaaagagtctggctctcttggtttctctcttgattcacctcttgccgtgtgatctctttgcacacaccttccactctccaccatgagtggaggcagcacgaggtcctctctagaagccgagcagatgccagccccatgcctcttatagttcgcagcctgtagaaccctgagctaaataaacctcttttctttatagattatccattcttaggttgtgtgatagcagcacaaaaaggatgaagacagggagctttgctccgattggcccagcttgatcctgcccctggcctgggccactcaagatgccagtgctcactcccaccgttgtgttcctgtgggccagcccctcactgggatgccattggtgtccacttggcctagaagtgcccatgataggaccctggtcatcctagtgaccaaacctaacctttcatttgactttttattgtagaaagaaatgcgttctggctggtggtagctcatgcctgtaatcccagcacttcgggaggctgaggcaggtggatcacttgagctcaggagtttgagaccagcctggggaacatggcaaaaccccgtctctagcaaaaatacaaaaaattagccgggtgtggtggcatcgcttatggccacagctactcgggaggctgaggtgggaggattgcttgagcctaggaggtagaggttgcagtgagccgagattgcaccactgcactccagcctgggtgacagagtgacctatctcaaaaaaaaaaaaaaaaagaaaaaagaaaaatgtgttcttcagtggaaaaccttaccctctttagaagataccacgccaggttatctgactctagtctgcactcaatgtgtgttttgcaaccctttttaagttttaggtcactgatagacatgcacaatgtgttgtccagtccagggtcaattttctctcctctcacagaggaaggaaatgagctttcttcccatttacatactcatttaaatactcctggttaatattcctctgtttgttggattctttttttctactggttattgtatctgctaatctcttataagttaaataaaatattttaacatgtgtttgtatctttatgagtgccagacttaatttttttaaaaagatgtattttaagcatttttaaggtcacaccaatatgcccaattgattcaactactaggaccagataaatttctatgacagaaagttgcatcaaatgcataactgaagcctgggcgtgtcttttcttggctctcctgcgtgactgcaaaacatcagtggaaatttgttgactctgcttttctcatttcaattttccattctgttaatttcatgttgatgagttttttgccacatttatagctgaaaagctgtttccacttttggcacaagggtttggagtttatttaattctttttattaagataaaatttatataacatttaatatattaatcatgttagaatttacaactcagtgctttttgttgtgttcacaagattttacaatcatcactatgtagttccagaacagtatgacacccccaaaagaaacctcacacccattaagtgctcgtttcctattgctcccctcactccccaaggccctggtaaccactaatccagtttctgttcctatggatttgcctattctgggcattttatacaactagattaataaagtctctggctttgatgtctgccttttgtcattgatcatgttgttttaaatagccgtccatatagaggcacatatcagtgcttcattcctttgtatggctaattgtccattgcatgaatgtgtctcggctgtgtatctagtcttccattgagggacatttgggtggtttccactttttggtgataatcaataatcctcgtatgaaaagcatatcaagtctttgtgtgggcatatgttttcatttctgttgggtatatcttcaggagtggaattgctgggccatatgataaccctatgttaaccttgggagaaacttccaaaatgttttccaaaatggctgcctcatttcaccaaccccccagcactgcatggggctctagtttcctcatgttttcccccacacttgtctgtcttctgaactacacccatactaacaggggtgaagtggatgttgagaatgtcttctgtgctcattgccctcttgtatcatttatttctctatcctgatgtgttgtcatcactaataattgaaagtcctcagaatatttatcccaagttaatttacacatgaaggacatttacaagggtataaaatgatttcctcagtgaatgtagttgtctcatttatttgcaatgtactggatgatagatttgattttcttattagcatactctgcaccctttttgaaataaaccatctgtcatcattttgtatacttagctagtaattttatgtcaaaattcataattcttcctggcctattttaaaagtttgggtatagtggatctaatagcacacacagtctttccatggcttttcttttttttcatgattaatgaaatggatttgaaagatgaatacctaaacttgaaaaacatgggaaaaagtgtcattgaaaacaatgaccacttttggtgaatgcttccaaatattaaaaaaaaaattttttttagtttctaattattcccagttgagttgagttgacacctcctaggagggcagaggctccgtttctggatcacactttctgtcacgggactgctcatagtggtgcttcaacctcggcacggggagagtaaataactgcacagtgtagaagcaatcaaggcagcccacataaactagagctatgcgactaacttaggagattgtctagtccttccacagcaggcagagctaagcctggatgccctggtcatggcccatgaggacaaaggggctgactgtgggaaaacaggcagtgatgagtgcagccatagaatggcaactatattatatagaaatcacttttctctgttttctaatttattaccataaggttgtttatattagtctctacgggtttaaaaactatcaattgttttaatcgtgtttattaatatttaagttagtctcttcatctttttctcaccattgcactaggtctgtgtattttatcataattttattccttttttgttatattctatgtaataattattctatattttactgtctaccttatgctttgttgttacacattactgtatttagcctatgcttctatgtataagttccagagactgacattaagcatgcatattgtcggcatcctttattctagtaattgaatttgcagttatcttattttgcctaaaactcttgaatcaaatagcgtgcacaactttgatttggaggagttatattgtcttctcgtgtaaaaaataatattaggaatattgcctagttttaatctttaaaatttaaaattctttaatatattatttacaaatattattacattataagtagcaaagctaatctctttgattaaaatattttatgcttggtaaaactttctttgaggccaggcgcagtggctcatgcctgtaatcccagcactttgggaggctgaggagggcagatcacaaggtcaggagatcgagaccatcctggctaacacggtgaaatcccgtctctactaaaaatacaaaaaaattaaccaggcgtggtggcaggcgcctgtagtcccagctactggggaggctgaggcagaagaatggtttgaacccgggaggcggagcttgcagtgagccgagatcgcaccactgcactccagcctgggctacagtgcaagactccgtctcaaaaaacaaaacaaaacaaaacaaacaaaaaaactttctttgatatacctaatgctaaatgatgagttaatgggtgcagcacaccagcatggcacatgtgtacacatgtaaactgcacattgtgcacatgtacttaaacaagtataataataacaaaaaaaataaaataaaattacattcaaactataaagttggagtttttatcaaaaagtacagacatttataataaaaacaaagtattttcataattaagccttgtaagttcctattttttttattttatatcaataataaccagcatgaaaaagcaaaaaaaaaaaaaacaactttctttgagaacaaaatatttcaatggtttcattgtgctgaaaaatgtgatacaaagctcagattcagcatatgtcaattaggacaagcatgtgtgtcgtattgttgaaaattttgaatcatcaataaatgttatctgtgttatcacaaatataatcacatcacaaagggtctgttaaagtttttcactgtggtcaaagaactgcacattttatcttatgattctgtcaaaagttcccccttactattcaaaccagcaattatcttccctaaaaaatgaagccatggccgtttttcccagataccttgtcttcagctcctccatggacagtggacggttccaccatagattccttcccaaagatcagaatgtgtggttcatcccacttctttctttggagcaggctaattgagattatcacttgagagataagaatacagaatattctacctccaaagtgttccaaaaaccagttggttttctctatgatccctctccctctttttttttttttttttttgagatgaagtcttgttctgtcacccatgctggagcacaatctcggctcactgcagcctcttgactcctggttcaagcgatcctcccacctcagcctcccaggtagctgggattacaggcatgcaccacctcacctggctaatttttgtaatttttagtagagacggggtttcaccatattggtcaggctggtctcaaactcctgacctcaggtgatccacctaccttggcctttcaaagtgctgggattacagacatgagccaccatgcccggccacaattctaatatttattagctgtgaatcaagttctaattaaaacttcttgataagattcttggctgggcatggtgggtcaggcctgtaatcacagcactttgggaggccgaggcaggtggatcacctgaggtcaggagtttgagacgagcctggctaacacagtgaaaccccgtctctactaaaacttataaaaattagccgggtgtggtggcaggcgcctgtaatcccagcttgtcgggaggctgaggcaggagaatcgcttgaacccaggaggtggaggttgcagtgagccgagatcacaccattgcactccagcctgggaaacagtgagactccgtctcaaaaaaaaaaaaaaaaaaattcttgtgctcactttgccccacccaggccattctgtttacttttacctgaaaatatttgaaaaatatgctactctcttcccaccaaaaaatcacatatctcaaatgattaactttcttttcaggatttaaggtaaaatgacaaaactggtctttgatgtcctgcagtatctgatacaccgttttccttcatgcttcattccaggccacttgctgtggtgttcctgcttttccttttcactttcttgataagcaattactcagtcttttccattttattaaactcttcttatatttctgtgtccagttaatttcaggatatttttaattaatcggttctacattacatactcgtataagctttccattgtctccaagttattagaggcccatttaaaaaagagaaaagagtttttagcttctaaacttctccactaaaatgtttaataaatgaaagttataccagcactttgggagaccgaggcaggtggatcacctgaggtcaggagtttgtgaccagcctggccaacatggtgaaaccccatctgtactaaaaatacaaaaaattagctgggcgtggtagcgggtgcttgtaatcccagctacttaggaggctgaggtaggagaatcgcttgaacctgggaggcggaggttgcagtcagccgagatggcgccactgcactccagcctgggtgacaagaatgaaactcagtctcaaaaaaaaaattataaaatcattttcaaaacatttagtctacacctgccattctcaccccatgacaatcctacgaaggcagaggatctgtttccagatcacactctctgtcatgtgactgctcacagtggcgcttcaacatcggcacagggagagtaaataactgcacagtgtagaaacaatcaagacagcccacataaattagagctatgcgactagcttaggagattgtccagtccttccacatcaggcagagctgagcccgaatgccctggtcatggcccatgaggacaaaggggctgactgtggggaaacaggcagtggtcagtgcagacgtgttcaccagccaccagctggggttagggtacttagccaaaaatggtgtgaagacagaggagagggtatagaatgatgcaaaggtgctcactagaacaaggatgctttgggtcactctgaactcaggggaggacctggtggggaggttagtcctgtgaaggtgttggacccactccctgtgcctgtgccgaataaagaccatggacctgctggcccaggtcatgaggcccaaacacaaaacatcgtaggatcatgacaacgttgtatgtagtaatcctgtaattctgttattacttactgcacaacaatatcccaaatctcttttccgtgtgttatgtttgttactccacttgtcagtcatactcctaagaaaaatggtatttaccagcatgttcagcacctagcacaggagggtgaaggccccaacgtatctgggagcttatagtttcagctctgcccacgtggaatttgtggggccgatcgtgatggcctggaagatactcagaaatcaggtggtgcccatgcacacacccctgcccactctgtggaaacagaaaacaaatttgcacccaatgtcactgaggaaatggccattgtttgtgggactcctttagagagaatgaccaaggagttggctatagtcaggtgctggagaatcagatctgtggactttaatgtgcatctggtgaaataaaggaaactataatgataaagaagaaagcaattgcccaggaatcctactgtggcctgagataagaagatcattcctattgtcacatccctggaggccatttgccatttttcaatgactgatcatcctattcagagtgagaagatcctgcatgaaaacaggaggcctgtggtaccatgacaactgaaatccactcttgtggaccatagttttcaaaccattaatttcctattaaatttcattttcctttttctgagagttttgctataaaaatatatatgtgtatatagatacatattcctagcataagagtgttataacagtgttttatgtataactgttacaacaattctctgaagggctttattgttcccatttgacaggtgaggcaatcttgggcacaggaaagctgaatgacactcccaaagtcacttccttgtaagaggcagtgtcagaagctgctagtgtacttgaccactatgctgtcttagcagcagatatatttatttatttatttattttgagatggagtggagtgcagtggcaccatcgcggctcactgcaacctctgcctcccacgttcaagtcattctcccacctcagcctcccgagtagctgggattacaggtgcgtgccaccacacctggctaatttttgtatgtttagtagagacagggtttcaccatgttggccaggctggtcacaaactcctgacctcaggtgatctgccctccacggcctcccaaagtgctgggattacaggcatgagccactgtgcccggcccagatatatttattttttaaaacaatccacatacttaaaaaaatattttgtatctcttgagtttttaaaagaatggttgtgagtcttgtttttcttttcaattgtgattgaaaacaacattgcttgttttctaggcaaacattatagtgattagagatccaagtaaaatatagatgggctgattttagtataaccttaaaagaataattatataaaccaaatggaatttattgaatgcacaaatggaattaaaagaggaggttcttttccatcttaaccaggaaggagcatacaatagaatgggcatgcgctaagcaagggagcaggaaaatgagtaggagggaaaacattgcaggagaaactaaattaccatgagtgtagaaagaaaatgagtatttgtgaatgcaaaaatatcaaatatagtatttcaatgtcagactggttcactatattaaaacacgagtccaccatgcaaaagaaaaactagaggtaaagattgtacattgactcaaaatagtactaagatgagcactgagactgcgaatggcatgaaaacatttttacaccagaggaaagatcacaaaataatgcaattctgaaaactgctgaagagtgtaacttttttcctgaatacaaaaacctaaggtcagttacctttctttgctgatttcatgaaggaaaacagcctcaccataataaagagacaacagattttttttctgtcacggcacagttacggtctccatttggtatattctatgcacagagttggtgaaaacactatatttactatttctgaacagaataagataattcaatcagctacatcttatacatgatcacaggcatggaggtgtcatggaaacaagtctacaaatcttagaaatgttcatgtagataagagagagcagctggcaaattaatttccaaattatattagagaacttaaaaataggccgggtatgatggctcatgcctataaccccaaaacttttggaggttgaggcaagaggattgcttgaggccaggagaccagcctgagcaacatagggagagcctgtctctacaaaaaattttttaaaatttgctgaatgttgtggcacatgcctgtggtcccagctactcggaaggctgaggtgggaggatcatttgagtcaaggctgcagtgggccacaattgtactctggcctgagcaacagaaagagaccctgcctcaaacaaacaaaaaaagatttaatgactttattgaaaccaacaatgatgaacagcgaggattacattaaatgagaagcagttaggggctggtttatggtcttgacctccattccttctccatgagtccagcccatgacccagtgattatttccctttccctgcattgtgttggcactgacttagtttctagcccagaagattcccatttcccagacaaaagcctttgctccatctcccagtacacttccttctggtgcaggctatgccttctagactgaaatagaaaatactcacctgatttttcccttgctgctgggacaatgcaggtttatgctcaggacagccagcagatgagtgtgcggagggaggcagccagctctcagatatgggtttttgtcctgtgacctcaccatttctcagcacttcaatgagcatttcacctgtggcaacaatgacagtgcacacttggggagctaaagatagtttaaagaaactttgtcacagttaccaatgaccaaaaacaagtataattttctagtgagcatctccagagagatgagagtgtttggcagaggttcttgctttccacgatcccttggaggcaacaggaagaggctcccaaggagggagcaggaagggctgagtccagactgaggggttggcagcagagcacacgcgtcttgccggagtctgtgctttcctgagatggtctcctatggaaaatccaattttctgctaatcctcagattcctgagccaaactatcatttgattatgaatagagaaatgggatcatgccaagaacttgagaaggatgtgtcagcaggttacagtgcaaacagcaacttgaagtccaatactgataggaaaaataaatggaaacaaatttgggcaatccaatgtaacttaacctgcaaatgtagatgttatatattctataaatatatattttatcaacatttacccccagagagatagaagttctaaattgtacaatatatataaaagaaacagacgtttatcagagtccctcacatacacaaaagcaccaagttcatatgatccagaaaggaattctactaatgaactgattgataaactgatgctacctaaactatttgaatcttaaagtagtctatcttcccaatagtttttaggaaaggtgcataaaggtgatatgagaacttaccatggtttgagccacatattacaaaaatataggacatatgaatataactataaaaaatttaaatattagaagcaattggctaggtgctgtggctcacgcctgtaatcccaatggtttgggaggccaaggcaggtgaatcacctgaggtcagaagtttgagacaaacctggccaacatggcgaaaccccgtctctactaaaaatacaagaattagctgggcgtggtggtgcacacctgtaatcccagctacttgggaggctgaggcaggagaatctcttgaacccaggaggcagaggttgtagtgagccgagatcgcgccattgcactccagcctgggcgacagagcaagactctgtctaaaataaaataaaataaaataaaataaaataaaataaaattaaaataaaataaaaagccattagggcagtcaccaatgttctatgagggatgtgtcttggaagaaaaagtctcttctgtaaggattactcaactggtacatgggcaggcaaggtgatccctagtggcctgccagtcttaagaaaaattttatgcatctagggaaaaattggtcacaaccaggcaattagatcgcagcctccccaccaagtaaaacaaaattctgtgttaagcacatgtaaaacaaaacaccagtacaaacccaaaatattttctcataggcattgtagagttttttgtttgttctgttttttgctctcgagagattaataagcagaatgggaccctcaaatttcaaagcatgcaataatggtccccccactcctgggacccctgccaggtatatgtttaaaaactaattcacaactgattttggctgggcgcggtggctcacacctgtaatcccagcactttgagggccaaggtgggcagatcgcctgaggtcagaagttcgagaccagcctggccaatatggtgaaaccccatctctactaaaaatacaaaaattagctgggcatggtggtacacgcctgtaagcccagttactcgagaggctgaggcaggagacttgcttgaacctgggaggcagaggttgcagtgagccaagattttgccattgtaatccagcctgggcaaaaagagtgaagtgaagctccatctcaaaaaaaaaaaaaaaaaaaaaaaaaaaggaaaaaagaaaaattaaggtcctctgtcttgcatgttttaatttttatttgtataaatttaagcggtacaagtgtagttttgttacatggatacactgggtggtgatgaagtttggtttatcacctgaatagtgcacattgtatccaccaagtaatttctcatcccttacaccctcccactcacccacccttctgagtctccaatgactatatatatatatttttttgagatggagtttccctctgtcgcctaggctggaatgcaatggcgggatcccggctcactgcaacctcccgcctcctagattcaagcaattctactgcctcagcctctgggtggctcggactataggtgcacgctatcacacccggctaatttttgtatttatagtagagacggggtttcaccatgttggccaggctggtctcgaactcctgacctcaggtgatctgcccactttagcctcccatagtgctgggattacaggcttgagccagcgtgcctgacctccaatgactattattccactttctatatccatgagtacatgttatttagctcccatttataagtgagaacatggaatatttgactttgtttcttttattttacttaagataataacctccatttccatccacattgctgcaaaagacatgatttcaaggctgggcatggtggctcacacctgtaatcccagcactttgggaggctgaggcgggtggatcacttgaggtcaggagttcgagaccagtctggccaacatggtgaaaccctgtctctgctaaaaatacaaaattagccaggtgtggttagtgcatgcctgtattcccagctacttgggaggctgaggcaggagaatcacttgaacctaggaggtggaggttgcagtgatcctagatcttgccatcgcactccagcctgggcaacaagaatgaaactctgtctcaaaaaaaggacatgattttatttattttttaattttgtagtttatcttagatataggaatacatgtacagatttgttagatgggactattgtggattttattctttttatggctgaagagtaatccattatatacataccacattttctttattcagtcatccattgatggacaatagcaaagatatggaatcaatctaagtgctgctctgagcatacaagtgcaggtatctttttgatataatatttttcctttgtgtacatatccagcagtagaattgctggatcgaagggtagttctatttttagttctttgaaacacttacatactcttttccatagaggttgtactaatttagttcccactaacagtgtataagtgtttccttttctccacctcctcaccagaatctgttattttttgactttttaataattgccattctgactggtgtgagatagtgtctcattgtggttttaatttgcatttctctcatgattaataatgttgcacattttttcatatgcttcatggccatttgtatggcttcttttgaaaaatatctgttcatgttctttgcccactttttattttatttatttatttttagtataatctgtacaacaatctttgcccgctttttggtggggttattttttttttggtgtgtgtatggagttgctttagttccttggaaattctaggtatcagtcctctgtcagatgcatagtttgcaaatatttcctcctattctgcaggttgtctattcactctgtttattatttcttttgttctgtagaagttttttagtttaataagacccatttctatatttttatttttgttacttgtacttttgaggtcttactaataaattctttgtgtggacaaactgttcaaaagagttttgcccaggtttcttctgctatgtttatagttctacaacttatatttaagttttggtccatcttgggttgatttttgtatatggtgagagatatgtgctcagtttcattcttttggatataaatacctgattttcccagcctccctgagtgaaaatggtgtcctttttccagtgtatatttgtgttgattttgtcaaaatcagttggctgtagacatgtgactttatttttggcttctttcttttgttccattgatctatttttatacctgtaccatgctgtttggttgctatagctttgtagtataatttgaagccatgtaatatgatacctgcagctttgttctttttgcttaggattgctttacctcttcaggtttttttggttccacacgaattttaggatttttttttaattctgtgaaaaatgacattgatattttgatagggattacactgaatctgtacatagctttgggcagtatagtcattttaatattacttcttcagatccataataatgggatattttcccacttgtttgtgtcatctacaattacctcatctttgttttgtagttctccttgtggagatctttcacgtccttggttaaatgtattcctaggcagtgggagagaatgataattgtggggatggaatttaaacattatgtatttaagataaaaaatattgtctcaaacctgtaatcccagtactttgggaggccgaggtgggtggatcacgaggtcaggagatcgagaccttcctggctaacacagtgaaaccctgtctctactaaaaaaaaaaaatacaaaatacaaaaaattagccaggcatggtggcgagtgcctgtagtcccagctacttgggaggctgaggcaggagaatggcgtgaacccgggaggcggagcttgcagtgagctgagattgcgccactgcactccagtctgggcgacagagcgagactccgtctcaaaaaaaaaagaaaaatattgtactgagcttatgatttgggggaagtttccaagtcatttaatatagtaagaaccttttctgtcatctttgctaaggctgaattgcaatgttatcatctttagggccccaaaagtaattatgttcacagatttttaatgctttaatctcatgtgtttattagacagtgaatgtttacttaaaattaacccctgacattttccaaattgactcacaaattggataaaagttatatatgcttttatctttaagtctactttaaaagagagtcttaaatttagaaatgccagaatgtatttacatgtttgtaattcaaaatggagtttctgcaaacacttaatttccaaattatatcaatgacatttaaatagattataattgaaatttgatgctaggagtaataatcataatgcaaattagttagaaaagttatgactgctcaaatattactgtcttacaaattacttataattatcatgccgaagttttgacacccatttaaaattcagtttcttagagatttaagcattataaggaaataagaatactctcttcttgtatagatgttaaataaaatatcttgtttcctttaaagatccaagaaattaaaatagcattttataacatgacttatgatagtcaacaatcatgtctttttttaaagaaaattgtaaaaattatttgaatccatgaatattgtttgttctcatttctctgaagccatattaggctaattttgagtgtcaaagttactccatcatgtggttttgagtgttaaaagcaaaacaaatagaagtgaatattctggccaggcacagtggctcacgcctgtaatcctagcactttggaaggctgaggcgggcggattacttgaggtcgagagttcaaaacaagcctggtcaacatggtgaaaccccgtctccactaaaaatgcaaaaagtagccagacatggtagcaggtgcctgtagccccaccacttgggagactgaggcaggagaatcgcttgaacctgggaggcagaggttgcagtgagctgagatcatgtcactgcattccagcctgagtgacagagtgagactccttcacggaaaaaaaaaaaaaaaaaagaagtaaatattctgtggtaacataatagttttttaagcaggacacacattgaccaaatatcttaaattttctttctaagttgttatgaactcccccacatgaaatagtagtcagttatataataaaagttttactgttcttattgaagttggataattaacagcagagtaagctcaactaatttacatgggaaaagacaacaatagtataaataaatttccttcatttgacaccatcaaacaaagttgtttaaactttctcgttcgttttcacatcgttatctcttcaatttatccaaagcatttaaaatatgttcttgttattcttcataataggtaccctgtgagatactgatttttcttttttaattattaacaggcaagaaaacgagagctcaaacaggatgaatttcaagatggcaatggcagaactcaaaattgcatttgtcagtgtccaaaaccactgttcttccacaagtcttttttatatagaattctttttctgtaatctattttgtttatgatagctaaacattcagtttcatttatattatgtattttatcttattgtttttatagtattttctttctctccatacattctaatcagtttattcacatggtcaaacattaacagcagatatttatgacaatttctatttaaaaaccttaaacattgattacattttcaattattttctccatacaggcatacctcagaaatattgtgcgttcagttccaaaccacaacaataaagtgaatattgcaataaagtgagtaacacagactttttggtttctgacacatagaaaagctatgtttactctatagtgtagtacattaagtgtgcaatggcattatgtctaaacatcaatgtacataacttaattgaaaatactgtattgctaaaaaatgctaataatcatctggaccttcagcaagttataacctttttgttggtggaagctcttacctcaattttcatggctgctgaccaatcagggtggtggttgctaaaggttggggggctgtggtaatttcttaaaataagaaaacaatgaagtttgctacatttactgacatcttttaagggaagatttctctgtagcatgcaatgctgtttgatagcattttaccctacagtagcatttctttcaaaattggggttcaccttatataaccctgccattgcttcatcaactaaatttatttaatatttgaattcctttgcagttatctaaacactgttaatagcattttcttggctcatccatgtaaatcattctagaagatccattaaaattttatgatgagattgcagcaattcagtcacatcttcaagctccactgctgattctaggtctctttctatttccaccacagcagtgcttccttcttccactaaagtcttgaatccctcaaagtcatcaatgaaggttggaagcaacttcttctaaactcctattaatgttgatattttgacctcctcccatgaatcacaaatattctttttttttgtatacatagagatgggatcttactatgttgaccaggctggtgttgaactcccggcctcaagcaatcttcccatctcagcctcccaaagtgctgggattacaggcatgagccaccgtgcccagcctccatgaatcacgaatgttcttaatggcgtctagaacagtacattctttcttttttttttttttttacttatttatttatttatttattattattatactttaagttttagggtacatgtgcacaatgtacaggttagttacatatgtatacatgtgccgtgctggtgtgctgcacccactaaatgatagactggattaagaaaatgtggcacatatacaccatggaatactatgcagccataaaaaatgatgagttcatgtcctttgtagccacctggatgaaattggaaatcatcattctcagtaaactatcacaagaacagtacattctttctaaaaggttttaaatttgctttgcccaaatctctctgaggaatcactatctgcggcagctataatcttatgaaatttctttctttttttaattaaaaaaaatttaatgttggtgggtatatagtaggtgtatatatttatggggtacatgagatgttttgatacatgcatgcaacgagtaataatcacatcatggagaatggggtgtccatcccctcagcatttatgcattgttacaaataattcaattatactcttttagttattttaaattgtacaattaagttactgttgagtatagtcagcttgttgtactatcgaatagttgaaatttatttctcagataatatgacttggaagtcaaatttacttcttgctgatccatgggctgtagaatggatattctgtgagcagacctaaaacaatatgaatctccttgtgcatctctgtcatagctcttgggtaactaggtacattatcaatgtatggtaaagttttgaaaaaaatatctttttttctgagcagtaggtctcagcagttggcttaaaatattaagtaaaccacactgcaaacagatatgctgtcatcaggctttgttccatttccagagcaaaggcagagtaggtttagcatcattcctaaggtccctaggattttctgaatggtaaatgagtactggcttcaacctaaagtgtccagctgcattacccactaataagagagtcagtctgtcctttgaagctgtgaaaccaggcattgacttcacttcttagctatgaaagtcctaggagacatcttcttccaatgcaagactatttcagctgcactgacagtctgtcatttggtgtggtcactttcctcagtgaccttagctagatcaaggtaacttgctacagcttctctatcagctcttgctgccttgccttgcactttcatgttacggaggtgacttctttccttaaacctcatgaaccaacttctgctaacttcaaacttttcttctgcagcttcggtcacttcctcacctctctcagcttttacagaattgaagagagttagggagtttctctggattaggctttggcttaaggaagcgttatggctggtttgatcttctattcagaccactcaaaatttctccatatcagcaataagactgtttgctttcttatcattcatgtgtttactggaccagcacttttgatttttttcaggaacttttatttgcattcacaacttagctaactgtttggtgcaagaggcctagctttaaggctatctcagtttttgacatgtcttcctcactaagcttaataatttctagcttttgatttaaagtgagagaaatgcaactcttccttttatttgaatacttagagaccattttagagctattaattggcctaagattgttgtgtctcagggaatagagaggccaagggagagagatggcaaaaagagaagaatgggtggtcaatgtagcaggcagaacacatgcaacacatattgattaggtttgctgtcttctatgggcacagttcatggcaccccaaacgagtacagtattaacatcggaaatcacgaattacagatcaccataacagatataacagaaaggaaaaagtttgaaataatatgtgaattaccaaaatgtgacacacaggcatgaagtaagtacacgctgttggaaaaatgatgccaatagaagtgtttgatgcagcgttgccggaaaccttcaatttgtaaaacactcaatatctgcaaagcacaataaaatgagggatgactgtatactgttcaatatttttttacttattatgaacatggtgcttttttaaatgatttttttgagatgtatctaaatagctgcaaagacattcattgtatgaatgtacaataatttaatgtaacaactatttttaatttttctaaaatatatttaaaaatttttaaatcacccataatattattattgaaattcatgtaaagcagtaaaagcaattagctgggtgtggtggcatgtgcctatagtcccagctactcaggaggctgaggcaggagaattgcttgatcctgggaggcagaggttgcagcgagccgaaatcgcgccactgcactctagcctgggcgacagggcaaacaagactccatttcggaaaaaaaaaaaaaaaaaaaaaaaaaggcagtaaaagctccctcttctgttcatgctgtaattttcccaaaggttaactttcttgtgtggatctttcacaataattttctaagtttgtaattatacatcaataagtatgtatgtagatctgacacagatctcagtcaccggtttccttagcgcacctgtctcatgtatccttggccatctactctgccaccagccatgccctgtggtttcctgctcaggcccaagtagctttgctgcctggtgacaaccagtgtgctgtctgtcctaggagtatagcctctgatacacagccaggtccagcagtgattgcccagagattccagctttttcctctgtaggaactagcaacccataaaatagcttgggctttggcatttgaactcactattgaaagaatgatgcattctggaggtatgagggagttaatgtcctatggggaatactttgtcaatggaaaaagaaggtaggaggaagctgagaaattaagcttctcttcccataatctactctgaagtgggatacctatttttggctcatccagaaaagtgttctatctcaagcagataattgtttcccactaatttactatagttttgtggtttctcataaagtaataaccactgactcccatttctagccaaccttatttctctttctcttacctatgctgccctttttctcacctccaaaagaaaacatctaatacgtgtatcagaaaacacaatataaaataatagatatgtacacatgtgtattaaaaaattaaacagaacaaatattaaacaaaatagctctgaaccatccatcatttcaacaagaaatcacaagggaaattagaaaatatctggagtggattgaaaagaataacacaataaatcaaaatacatggaaagaagctaaagcaatgcttacagggaaacttatgaattcaaatgttttgctagaaaggaagagcgtctcaaatcaattacctaatcaacttaagaaacaaaaacaaaaacaaaaataaataaaataaaagaaataataataatcagaacaacaattagtgaaataggaaacacaaaaacaatagagaaaacaatgaaacctaaaattgtatctttgaaataacgcaactggtagagattttactggactcatcaagatgaaagagagaaggcacagattgtcaatatcaggaatgaaaggcagaaccttacaacagattcaacagaaatttaaaaagaatttaaggctgacatggtggctcacgcttgtaatcccagcactttgggaggttgaggtgggtggatcgtttgaggtcaggagttcaagaccagcctggccaacatggtgaaaccctgtcactactaaaaatacaaaaaaaaaaaaaaaaaaattagccggggtgtggtggcacaggcctgtagtcccagctactgggaagactgaggtaggagaatcgcttgaacctgggaggcagagtttgcagtgagccaagattgtgctactgcactccagcctgggtgacagagcaaggctccatctcaaaaaataaaataaaataaaataaaaaaagtaaggtaatgatgaacaactaatatcaacaagtttaacaacataaatgaaataataaaattcctagatagatattaagtagaaaaactgacttaaaaacaaaatagaaaatcttaatagatgtatataaagtaaaaaaaaattgaattagtaactaaatatattcccctgaagaagagtgtagtgccagatggcttaacctgtgaattccatctaatatttaaggaagaaagaataccagtcatacacaaacattttcagcaaatggagaaaagagcatatgcccaaacattttagaaagccagtattagcttgataccaaggcaggatggcgacatcagaggaaaagcaccaagcaatatctgtcataagtttacatgcaaacatatttaacaaaacggaagcaaattaaatccaacaacatgtaaaatggtgatacactgtaactctctggaattaatcctagtaatgcaaatttggtttactatctaaaacccaatgaacatagtacatcatataaataaaataaagtagtaaatcaatagaatcatctcaaaagacataaaagcattttgacaaaatccaatgctaatttctgataactcacaacaaacatacgtaaaaaagtgaaaaaaactagcataaaggacagaggagagtaattggaattataccattttaaggctcttgccttaaacaaaaatgttaaaatattaattcaagatagactatgataaagatacatattgcaatctttctttctttctttctttttttttttttttttgagacagagcctagctctgtcacccaggctggagtgcagtggcaagatctcagctcactgcaacctccacgtcccaggttcaagcaactctcctgcctcagcctcctgagtagctgggattacaggtgcctgccaccatgtccggctaatttttgaatttttagtagagacagggtttcaccatgttggctaggctggtctcgaactcctgacctcaaatgatctgcccgcctcggccttccaaagtgctggggttacagtcgcgagccactgtgcctggcctacatattgtaatctttcaattaacaaaaaaaatgaaaacaaacagatatagctaagaagacagcagaagtgataaaacagaagactaaaaaataggcacactaaagaaagaatagtttaaaaaaaagaagaaatagaaaacaaataacaacagggtacacttaaacctagtcattttcaacaattacattaaatataaaagggcccaggcttcatggctcatgcctgtaatcccagcactctggaagctgaggtgggaggatgacttgagaccaggagtttgagaccagccctggcagtgagatgctgtctctgtctctgcatgcactgtgttttttttgtttttttttgagggagtttcattctggttgcccaggctggagtgcaatggcacagtctcagctcactgcaacctccgcctccaaggttcaagcgattctcctgcctcagcctcccgagtagctgggattacaggcatgtgccaccacgcccagctaattttgtatttttagtagaaacggggtttctccatattggtcaggctggtctcgaactcctgacttcaggtgatccacccgcctcgtccttccaaagtgctgggattacaggcgtgagccaccgcgtgcccggtcaaaattttttttttctttgagacggagtctcactctgtcgcccaggctggactgcagtggcgcgatctctggctcactgcaagctccgcctcccgggttcatgccattctcctgcctcagcctcctgagtaactgggactacaggctcccgccaccatgcccggctaattttttgtatttttttttagtagaaacggggtttcactgtgttagccaggatggtctcgatcttccgaccttgtgatctgcccacctcggcctcccaaagaaaattttttttaaaaaataaaagattagctgggcatggtgccatgtccctgcagtcctagctactcagaaggctgaggcaagaggatcctttgagcccaggagtttgaggttacaacgagctatgatcatgctactgcagcccagcctgtgtgacagagccagaccctgtttctaatacataaataaatatagaagggctggatatctcaatttcaaagttcggattacttatgagattaaaaaaaataaataagacccaaccctatgctgttcacaagaagcatattttagatatagaaacaacacgtaggcaaaagtatgggtataaatgtgtcatacaaatgctcatcctaaaagaattggtgtgcccatattaatattagataaagtggtcttccaaacaggagtactgccaaagataaaggggtcaagtcacaatcaaaataggccagttcataagattaacaatcttaaatgggtgagcctaatgaaacttcaaaatgtgtgaaacagacatcaacagtaaaggtgacgataatcagatctacttttttaagtgtctgtggaacattaatcaagacagatcaaatactggaccataaaacaattctcaataaatataaaatgatttaaatcatagagggtttgtatactgagcaaaataggactaaattaaacatcaacaacaaaaatatactcagaaaaccttaatatttggcaattgagcaaagaacttctaaataacaatgaataattctcagatatatatgttaatttttttattgtgttaaaattttaacaattttaagtatataattcagtagcattaagtacattcacagtgttgtacaaccatcctattaatcacaagccaaaataaagtacccattaaacagtgactcaccattacttcctttggtattttaggtagagtatataatatatatttcgtgtactttgatattttatgtacagtatataatatgtaattggtgtaatttgatattttatgttcagtatataatatgtatttggtgtactttttgatattttatgtacagtatataatatgtattttgggtactttgatattttatgtacagtatataataagtatttggtgtactttgatattttatgtacagtatataacatgtatttggtgtactttgatattttatgtacagtatataatatgtatttggtgtactttaatattttacatacagtatataatatgtattttgtgtattttgatattttgtgtacagtatataatatatattttgtgtactttgatattttatgtacagtatattatatgtgttttctgtactttgatattttatgtacagtatataaaatgtatttggtgtactttgatattttatgcacagtatataatatgtatttggtgtactttgatattatatgtacagtatataatatatatttggtgtactttttgatattttatgtacagtatataataagtagttggtgtaatttttgataatttaagtacagtaaataataagtatttggtgtactttttgatattttatgtacagtatgtaatatgtatttggtgtactttttgatattttatgtacagtacataatatgtatttggtgtactttgatattttatgtacagtatatagtatatatttggtgtactttttgatattttatgtacagtatataatacgtatttagtgtactatttgatattatatgtacagtatataagatacatttggtgtactttttgatattttatttacagtatatgacatgcatgtggtgtactttttgatattttatgtacagtatataacatgtgtttgctgtactttgatattttatgtagagtatataatatgtatttggtgcactatgaaattttatgtacagtatataatatgaatttggcgtactttgatattttatggacagtatataataggtattttgtgtagtttgatattttatgtacagtataaaatatgtatttggtgtactttgatattttatgtacagtatataatatgcatttgatgtagtttgatattttatgtactctatataatatgtatttggtgtattttgatattttatgcacagtgtataatacaccaaatacaatttatatactgtacataaaatatcaaagtacaccaaatgcattttatatactgtatataaaacaccaacgtacaccaaatacatactatatactgtacatagtttgaaagtacaccaaatacatattatatactgtacataaaatgtcaaaaagtacaccaaatacatattatatactgtacctaaaatgtcaaaaagtacacgaaatacatattatattctgtacatatattatcaaaaagtacaccaaatacatattatatactgtagataaaatatacgaaagtacaccaaatacatattatatactgtacataaaatatcaaaaactacagcaaatacatattatatactgtaaataaaatatcaaaaattacaccaaatacatattatatgctgtacacaaaatatcaaagtacccaaaatacatatgatatactgtacataaaaaatcaaagtacaaaaaatacatatgatatacagtacataaaatatcaaagttcaccaaatacatattatataatgtacataaaacatcaaactacagcaaatacatattatatactgtacataaaatatcaaatagtacaccaaatacatactatatactgtacatcaattatcaaagtacaccaaatacgtattatatactgtacataagatatcaaagtacacttaatacatattatatactatacataatatatcaaagtacacaaaatatatattatatgctgtacatataatatcaaagtatacataatatatattatacactgtacttaaaataccaaagtacacaaaatatatattatatactgtacataaaatatcaaagtacaccaaatacatattatatactgtacataaaatatcaaagtacaccaaatacatattatatactgttcataaaatatcaaagtacacaaattacatgttatatactgtacataaaatatcaatgtgcaccaaatacatattatatactgtacataaaatatcaaagtacacaaaatacatattatacactgtacataaaatatcaaagtatgcaaaacatatatactgcacataaaatatcaacttacacgaagtatatattatatactgtacataaaatatcaaagtacaccgaatatatattatatactgaacataaaatatcaaatcacacatattatatattatatactgtacataaaatatcaaagtacaccaaatacatattatatactgtacatgaaatatcaaagtacaccaaatacatattatatactgtacataaaaagcaacgtacacaaaatatatattatatactgtacataaaatatcaaagtccaccaaatacatattttatactgtacataaaatgtaaaaaggtacaccaaatacatattttatactgtacataaaatatcaaaacgtaccccaaatacatattatatattgtacataaaatatcaaaaggtacaccaaagatatattatatattgtacataaaatatgaaaaagtacacctaatatatattatatcctgtacatcaagtatcaaaaagtacatcatatatattatatactgtacatcaaatatcaaaaagtacattatatattatatactgtacatcaaatatcaaaatgtacaacaaatatatattatataatgtacatcaaatattaaaaattaaccaaatacatattatatactgtatatcaaacatgaaatagtacaccaagtacttattatatactgtacatcaaatatcaaagtacacaaaatacttattatatactgtacacaaaatatgaaagtacaccagatacatattatatactgtatataaaatagaaaagtaccccaaatacatattatatactgtacacaaaatataaaattacagaaaatacatattatatactgtatataaaatatcaaagtacacaaaatatgtattgtatactgtacataaaatatcaaagtacaccaaatatatattatttactgtacataaaatatcaaacataccaaatacatactatatactataactaaaatatcaaagtacaccaaatacataatatatactgtacataaaatacctaagtacaccaaatacatattatatactctacataaaatatcaaagtacacaaaatacatattatatactgtacataaaatatcaaagtacaccaaattcatattacatactgtacataaaatttcaaagtacaccatatacatattatatgctgtgcataaaatatcaaagtacacaaagtacatattatataccatacataaaatatcaaagtacactaaatacatattatgtactgcaaataaaatatcaaaatacacaaaatacatattatatactgtacacaaaacatcaaagtacagaaaatacatattatatactgtatgtaaaatattaaagtacaccaaatacatattatatactgtacataaaatatcaaattacaccaaatacatataatatactatacataaaacatgaaagtacaccagatacatattacatactgtacattaatcatcaaagtacaccagatacatattatatactgtacataaaatatcaatgtacacaaaatacatattatatactgtacataaaatatcaaagtacaccaaatacatattatatactctatataaaatatcaaagtacaccaaatacatattatatactgtgcataaaatatcaaagtacacaaagtacatattatatagtgtacataaaatatcaaagtactctaaatacatattatatactgtattcaaaatatcaaagtacacaaaatacatattatatactgtatgctaaatattaaactacaccaaatacatattatatactgtacataaaatatcaaagtacaccaaatacacattatatactgtacataaaatatcaaactacaccaaatacatattatatactgtacataaaaaatcaaactacaccaaatacatattataaactgtacataaaatatcaaagtacacaaaatacatattatatactgtacataaaatatcaaagtacacgaaatatatattacatactgtacctaaaatatcaaagtacacgaaatacacattaaatactgtacctaaaatatcaaaatacacgaaatacatattatatactgtacctaaaatatcaaagtacacgaaatacatattacatactgtacccaaaatatcaaactagacgaaatacatattatatactgtacctaaaatatcaaagtacacataatacatattacatactgtacctaaaatatcaaagtacaccaaatacatattacatactgtacctaaaatatcaaagttcaccaaatacacattttatactgtacctaaaatatcaaagtacaacaaatacatattacatactgtacctaaaatatcaaatacaccaaatacatattacatactgtacctaaaatatcaaagtataccaaatacatattatatactgtacataaaatatcaaagtacacaaaataaacacttatctttgttctgtcttcacaaatttgcctattgtagatatttcatatcaatggaatcacacaacatttgtctttttatgtctggcttacctcacttagcatcacgtttccaagtttcacccatgttgcatgcatgagaacttcattccctttaatggatgaataatactctattatatatgtatcatattttgtttatccattcatttgttgatggacatgggctgtccctgccttttggctatggcaaataatgctacaataaactttggtgtaaaaatgtctgttccagatcctgctgtcaacttttttgtgtgtaatacctaggagtggcatttctgggtctatgtgtgattctgtgaggaaccaccgaactgctctccacagcaactgcatcattttctgtttttagcagccaattcatgagggcttcattttctccacatccttagcaacatttattttctgtttcattgttgttatgaaagccatatcggaggatggaaagtggtatttcattttggttttgatttgcactttattaatgaataatggtgtttagcattttttttgtccttattagacatttgtatattttctttggagaaatgtctattcaagtcctttgcctattttttaattggaatgttagaaattttgttgttaagttgtgcgatattaagcttttatcggatatatgttttgcttttatcagataaatattttctcacatactacgggtggtcttttcactcccttgatagtgtcctttgatgcataaaatttttcgattttgattaaatctaacgtgttttttcttttgttatctgtgcttttgtgtcatatttcaaaaagcatttaaaactcaaaggtcataaagatttacgtgtgtgttttcttctaagagttacatatttttagtccttacatttaagtcttttgttaatttagagttaatttttgtatatagtgcaaggtaggggtctaacttcactcctgtgcatggatatccagctgttgaagagagtgttctttcctccattgactggtcttggcctccttgctgaacagtcattgaccatatatatgaggactaatttctaggatctcaatcctattctgttattttaaatgtctattgattttatgccagtaccacaccctcttgattactgtagatttgtagtaggttgtgaaactggaaaatgtgagttttccaatgttctttttcaagattgttttgtctatgtcagattctttgaatttttgtatgaattttataatgggtttctctgtgtctgcaaaaaatgtctttgagattttgatggtatcgtattgaatctctagattactttagatggtatggtcatcaaatattgtcttacaacccatgaacacagaatgtctttccagttatttaaactcttcagtttctttcagcgaagttttgtgcataccaccatgtttagatttatgcctgaatatcttattctttgatgctattataaatggaattttaaaaatgtttccatagttcattacagctatatagaaatacaactaattagcatgtgtttgtcttgcttccttcctcttttattagttctgatgggttttgggtattctttagagctttatacacataagatcatgtgtagatataattttacttctatttttcatttctaatttagatgccttttatttctttgtcttgcctaattgctctggctagaatttccagtgctatgctgaacagaattggcaaatgcaccatccttgtcctgttctagatgttaggaaaacagctttcagtgtttcaccattgagcacgatattaactgtcagttttttatatcccattgtcatgttgcagaagttcccttctgtgcttagtttattgggtatttttatcataaaagagagttgtatatcatcaatgctttttctgcatcaattgaaataatcatgtgcttattcattttactgttatagtatattacactgatcggtttataatatgttgagccacacttgcatttttgggataaatctcacttggtgatagtttacaatcctttgattatacagtagtgctgctagtattttgttagtattgctagcattttgctgagatttttgcctatattttcataagggatatcgtgctttagttctctttttttgtgctttgtctggctttggtatcaggataatgctgttatcaaaaagtgagggttgggcgcggtggctcatgcctgtaatcccagcactttgggaggctgaggcagttggatcatgaggtcagtttgagaccagcctgaccaacatggtgaaacccccgtctctactaaaaatacgaaaattagctgggtgtagtggcagggacctgtaatcccagctactcgggaggctgagacatgagaatcgcttgaacccaggaggcagaggttgcagttagccaaggtcgtgccactgcactccagcctgggggataagactctgtctccaaacaaacaaacaaacaaacaactccccgcccccaccccacaaaacaactgaattggcaagtattctttcttcatacattttgttggaagagtttgagaagaaatggtattaatttttctttaaatgttagatagactcacatttaaatgttaggtagatttatgaccaaatatggctatttggtcataaatctttttttgttaaatggtttttgattactagtccaatcttcttgcttgttatctgaatgcaggtctattcagattttctctttcttcttgagctattttggtagtttgtgtctttccagcaattcgtccatttcatccagggcacctaatttgttaatatgcagctgttcacagtattctcctataatccttttttatttctgtaaagttggtagtaatggctctactttcatttatgattttagtgatgaaagtcttccatcttttgctcagtcaatacagtgaaaggtttgatcttttcaaagaatcaacttttagctgtgtttatttcttctactgcttttcaaccttctattttattgatttatactctaatctttattatttctttccttctgctagctttggatttagttttctctggtttttctactgcttttaggtacacagtgaggttactgatttgagattttttttttaatgtgattgtttatatccatacattttcctttgaactctactttcactgcattcaataagttttggtatgctttatttttattttaatttgtctcaaaatactttataatttcacttgtgatttatcctttcactcactggtagtttaagagtacattgtttaatttccacatatttgtgaattttcccattttcattttttatttatctgttgtttcttccattgtggttgtaaattatattttgtatgatttcaaacttttaaaaatgattaggacatatttttgcagaggaagatatggcctatcctagagaaagttccatatccacttgaaaataatgtgtattctgctgttgttgggtggactgttctgtatctgtatattagatctaagcggcttatactattgttcaagtcttctgtttctcatgaagcttctgtctggtttttctacccattaattaaaatgaggtattgaagtgtccaactgttattatagaactgtgtgggtttaaccttttaatcctgttaaattttttcagctttactgaggtataattgagaaataaatgtgaacatattcaaggtttgcaatgtgatgtgtttctatctatatgcacattctgaaatgattaccaaaacgaagtcaattaacatattaattacctcacataatagctttttgtgcgcatgcgtgggataagaatacttaaccccatccccagtgactgcagagtggcccttccagctgttccaggctctggcagaggaggagcagagcgggtggcaccgccaggggagccctcaggcctggcgcgcacgcattccggaggtcgccaggccatgctccgtcgcctgggcgcccaagctgcagccccaaatttttgggtggattgtggttttggggtggatcgcggatttggggctgcacttgggcgctgcccggcaactccccagcccgctcacactgccagcatcgcagagccggggccagaagtcccggtgctgcggccaagccaggcgttctgcccggcggcggctgcacaggggcgagaactgagaacctgccgctcaaccccatcctgggtgactgcggagtgcccatgccagcggcttctgtctccctgcggcggaggagcggggcgggaggcacggcctaggggccctcaggctggtcgcgctggcgatcccgaggccgcccaggccatgcccctccagcccgcctgggcacccaagctgcagtcgccctctgtgtgcaggcagcagcctccgggaaacctctaagcccgcctgctctccgaacatctaagaaccaggaccagatgtccctgtggctgctgccgagccaggcggtccgcccgacggcggctgcacaggggcgagaacctgccgctcaatcccatccccggtggctgcggactgcttctggccagcggtcccgagctccgtcagaggaggacggcgggtggcacgaccagggatttgagggtagattgcggtttttgggtggatcgcggatttgggggtggatcgcagatttagggctgggaggcggggtggaaaggctacctggagccgcggcggctcaggagcgggttgttgagcgtctgagaagtcgccaccacgaggaagcgcttcagcttctggagacgcctgggccaggcggtcctgctccatcgaccacgagtacccggatcccgggtaccacacctgggacgcggaactgcggaagatccacagggcggcagtgaggggcgacgccgcagaggtggagcgccgccgcagaggtcgagcgccgccagatgcgcagaagccgggacttgtacgcccgcgacaggaaagacaggcagcggggcctcagctccaggtgggagggggccctaggcccggcttcccgcagccccgcagccccgcagccccgcagccccgtagccccgaagccccgcagcacctggggcggggatcttggagggcgccgggcaccctcggaacagcgaagccaaacggagcctcagctgctttctatcgctggcaattccccgtctggagcacttggtggagaatttgatttatctcacaaagttaggcatatacacgtttaaaagataagtctcatatacatgatagggaggtgcctaatgagaactcattcccatatcaaaaatgccatgagtcattttcagtaggcgaaaagttctccgataaaaccctgcgtctgttttacatccgaatccacctatgtagataaattctttactggggctccttagagggaaacttggaagtgggaggtgggttccgtgttcttgaatgggaagactcagttttctcaaaatgtgagctctttctatatttatcagttttacgtaaaccaagtgaaaatatcaacgttttaacatttttgcatgacacttgctgtctgtctttttctcttgcgatgacatttaaacatttttataatggagtgaaaaaagtcttgctcctctagatatcaaaatgtgctattaattcccacaattaactgttgactaacagctgaaaagacgtaaatacatggaacaggataggaaatcccaaaacactgagataaatgtaagatatatacgtagggattgtggtaacatttcagatgagtaggaaggtatgagttattaataacgtgtcctatttgaagaaaactaataaaattttgtgcgacaaaaatgagttcctgaaagaatacagattgaaattattacatatgcaaaacgaagaaagtaccagaagaaaacagaaatgcttatttatacaggtacattttatattgacaaaggccttcctaagaatgacctcacaagtaggcattctgaaggttgatttagcaactaaaaattaaaaccccttgtgtatcagaaaaaattaacaaaagatgacatacttgaaaaatgctataattttttactatatataaatatatattaatacatattcagatgaaaagtgtgtctttattctacagggaacttattacattttttattatatataatatatattactgattataacaaattgtatatattactgatataatatgttatatatatcagttttatacacacacacacacacacacacacacacacacacacacagataaaaagcacatctttattttacagggaattctttcaaataaaatccagaagaaaagaactctaaaagtgagcaaagtacttttttgcagatccacaacttaacttacgtacataggaaaaaatccttagtgtttctcataagagaatttaagttaaaagagaaatgagactgttttctatccacaatgtttgtgagaataaagagcagtggtagttatactgctgcttaaagtttaagttgctgatgacttttcaagtagataatttggtggtaattaccacatttaaaaaatctatatgccctttacctatcaattccattatattaaaatacctttagaaaatagagatacatgcactttgttttttctcagcacttattttaacaagaaatgataggatagatcctataaataaatttcagttgcatccataggatggaataatatgtgaccattttgttatagccagtgagaaaaaaaagtcagtttgcttgcatatacacacaaacatactatggtcttgtgttagccaaaactatgtacaaaatatgataaaaattgtaacttctgagcattggtattttaagtaaagtttcttgctcctttttcttatctgtgatttccgcaatgatcatgtataaaacttctagtaaaagtttattattaatggaataatccttgggaagagagaatatgaatcttgcacaggtaaaaataatttctcgctgtctattttatcattattattgcgtgggttgttatcttctttgaacttttagcctcttcagaagtaaaaagggaatctttttatgtatgcttgcagattttattatgtatatattttattaggtacatatgcttttcttatgtatagattcattgaatatatgcaaacaatgacagattaaacatttcattttgtattcttacaaaaataataaatagcaaatataattactatcacaaaaatattgttttataaaagttttatttaaaaatattgaactccacaactgtatttatccattctttcaatccatttattcatcaaacataacatgaatgcttgttatgtaacagacatattctactatctctcaggatccttccatccttaaaaagttcatgtttacctgccctgactgagcagtttaaagaatgtatatataaattacatgtatatatatataaattaattcttttaatttaattagtttagcttagaattcagagttatttcagaagttagttgtagctaattcataatctcaaacagtattgtctggaatcttctgatccatagtcagacacgttatccatcgcaccactggcccgcggtttctcaaacagtactgtctgaaacaaattcatttacctaattatgatccctgaaattctatatatttttgtattaatataaacaagaaattagacttttaagatttttaagttagtgtgttgtatttttctctatagtcatattataacaaattggacttatgcaaatggttcttctatttaatttttataataaatggtttgtatttagtagataaatattaattacacttgattcttgaataatgtgggggttagggactcttatttctgtggaattgaaaatccgagtataacttttgacctcttccaaactagcctaccattgactggaagctttactgataacataaacagtcgaggtacatatatttggtatgtgctgctgcattatttactatgttcttaaaataaagtaagctagataaatgaagctgatataaagaaaatcatagaaaagaaaaaatatacttactattcataaagcataaatgaatcctcccaaaggtcttcatcttcatcatcttcaggtttcctgccctctgcctcttttaatctggtggacctcattctttaagtctcagctcaggcatgatctctagaaaagccatccccgaaggttttattcctattctttacaccccggtgcctaccacttagtaggaactcaataataaatatttggtaaaataaagactgtttatacaaagatgattgctacagtctagctgcaaaggggatagacatgcaaagacatgatgtacagttcaggtggtgaagtgacactagaaaaattgacaaagtactaagggagccccaaggaaggagatgcctgtgtatgtggagaaagatagtcagattcaaggaggatttcacatagcattctgagcctttttttttttctttttctgtttttggagacacattcttactctgtcacccagggtggagtgcaatggcatgattaagactcatagcaaactcaaactcctgggcttaagggagcctctcgtctcaacctcttgagtagctgggactacaggtgctcaccaccatgcctggcaaattttctgtagagtcagggtttctctgtggtctccaggctggtcttaaactcttggcctcaagcaattctccttcctgggccttccaaagtactgggattacaggtgtgagctactgtgcccagcctacattcagagtcttaaaaaatgaaaataaatttgtcagaatagtagaggaaaacatttctgatgtaaaaaatagggtgtacactaataaaggtacaaatggtaacaataattttgcaaattattagtaaataccaacttgcatagcatgttgttaaaaagatactattatgaagtagagaatagtaaagtgttactttatatgtttttactgtatttttaaattttgttttgtttccagaagttttgtttatttatgttgggtggaacaatttgtgagcaaaccttagatttttgcatggcttgaacctactgatacctagtgtctccccaagtggtgcgttgaagtttcagataactagaagtatttcttaaagatgtaaatattccagtaaacattaagctttatttaaactctcaatttataaaataagagtatatattattttgtatcaatttttataaagattatagtcgttatctaaccgttctaagtcactcattttaattaaacatgtggatttgtcagcagaacacgacttaaaagtggcttcagaggaaaagcaagaaaggcttgaaagatgtgaaaataaacagccacaggtatataaaaatttaaattttaatttctggcttactattggtttgtttgtttctttttctttaataacatggtatagtccaaatgaagtgaccttctggactatcccttttagaatccaacagataatcatttcatatttaattttaaaacattttaaccagttataaaatttaaaaaattcttacagtctgtagtaactcatagctatctttacccttggaattgaggccagaaatttccagaagtctctttgctcttttatttttataaccttcttcatgataaagaaggtaacatcaaaaattgagttgtgctactaagcaagagaaattacgaacaatttaacagtgatggccactgaattcaactcatgttaaaggactcatcattgccagtggcccaaactttgcagttttatgttgccagtcactagtggctgaggttaaagacttctgttttttggtctctggttgcctccagtgtctatgttcagggagagaattgggtcataaaatcaacccaactgcctattaagagaatcatgccttccagaatgggacctttggtattaggatacaaacaaaaactttcttattttaacataaatagtaaatgttattaaaaattttaagtccactgtcactagtggaacttagaatatattagaactggatataagcagataatctatctagatacataacactatcatattacagtatagcatttgaagtagaatctaaaaattttcttctctttctaattggtgttcattttggcttctaataatttggcatttgcctaccctacagttaatctttagaagtataaattcactgtaggggttcactatttatggtatgctgaggtaaaagtcttttaaagagagaaagcttttataatactacatatcttctgtgaacctatttctggtagatttaactcataatgaattaaatttagtcccaagaaacaacgagagttaagcttgatggttcatgtttttctcctgtgttagaccaaggcaaattagtttttacttcttagttataatccagtagcttaggggtagcaaaacatagaataagcttcacagttaaattttaattatgttataatttttctttgctcatacttgattacttcagaataaagttaattttaaaacatgcactctgacagagaaggcatctgagaaacaaaacaagcaaatgaattttccacctgcaaaaaaatgtctcgagaacaagaactgagtaagaattgtgataaagaggatatgtctattcagggcttcctttaaaattcattttaaaaacgttcaactgaagattggtgaaagttttgaaatattcaaaattactgtttgtcctgaggaagcgttcgtacatagtaactctaaagagggacaaacttaaagggagtgccctctaatctgatgaatcatatccctgatcatgaggaagcagatgcatctggagtgtctaactgtagtattccaggcattgcctgaacagaaggaatgtctgttcattcttcaaacatgtcttgtcattgcatttataccttgggttcctcaaacaaacttgccagtcatcttctaagctttattcaaatgaaaacaaatcagactataaaaattataacaaacagttataaacagaccatagcctgtttctaacagcgatgaagaaaatggttgaaatgatacagaaaatgaaaaattaaggagctcagtagttacggttgaaataaaagaaaacccagagtttgataatgcaagtgataaaaaatataaaccaaaataccactgattggaaattacacattagacattggcctcagtctagagatccaaaaagtctttttgatttgtggtttggccactccaaagaaatgtatcatgtgatacagatagaaagccacagtatttccgctgttgcagacacttataaaaatagaaaaccaatacagcacttgttccacaattcatgtggatcttagaggctcttctaaagcttaaagatgactggcaagtgtgtttcagggacctacatatgacagtcccactgttaataactataaaagcataaaacatgaattagaagttattctccaccctgtagtgacagaacatcaaaagcatatctagaagaagacttacagcaagatatccaaaggtttaagaatgaggtgggcatgttacaagtagagtccctggctttgaagaaagagaaagtttaactacaaaatgacagaggttcacttgctgttctctttttataagttatctgattcattctgattttctactcaagaaaatctcatgtgtatggttacactgtggttatctaaatgtgtaattatgtgtcaaagtaaattagtgctgctatctaaatgacacttctggaaatattcttgtaatctttgttgattactcaacccaagtctcactattagtctttcaagtggcttatgggctgggaaactaatttagccatataccatgtgatcttctgaaccagataagcataaagaaaattgctaaagaaataagctctagattcttttttctgtattcatttaaagacgaattacatttatttaaatgataaaatggtaatacagtgggagggaagcaatgactgagaagagacataaaaatatatcttgccttgagagttgcaacaaatattcccatccaaagaagtctgtttaatgtgctttcatgcatgcaagtttatctgtttgactcaaactgtttaaacttattattccatcatggtcattttaaatatttttggaaacaaatacatatactttcacatattaaaaaaaatcaccactctccaatgtttctgttgaatcagaatttacgttatgttgtttattaaaatatgttaagttttgacatgtatgattttgtcatataagtagcataacccctcagccaaaaatttagcatttgattctttagttgaaagctgagttctgtacattttgttctaaagatagacaaaaatctagagattttcttttttcaaagtaaaagcagatgaggcctcccactaccctcggaggcatgatctaggagacagcagaaagcagtttcaattctagtcatatttctagctctagctctacatgcaagtacctctgagaagtattttcattggcctatacacaatgaggatactgatacatgtatattataaaataaaaatgtgaaatacagatgtagctaacattttacaactgaagcattcttctagtcactggtaaatgaaaacaccttaactaaatcatatggcaactacatgtgtgaagcttactaaataaattgtttcataaggcattttttatagagaagtatttattctccccagtcattccctgcttactccactttctattgggctttttgcatgtcaaatttgaaaacatgaacaaacaaaataaagtgaacatggtagtttattattatgaaagtaattgtaatgtataagttagatgtccctgtgctattgacaaaattctctaaaaaccttttgaataaatgtgacaaagactacctaagttgatgtccacaatttgagagaaaagaaagacaaaaacagtccttgaggactcagatgcctcaggaagatttaagaagtttttatactttgatggagcttttaagaaaaattcatctatttttttccttgctctggtcacatactgagaggacttacagactgcttacttaatagtatggatttgtatttttcttagagtaaagtagcatcctgattttgaaatagttcctgtagtttgtttaaagaaagcaggaaagaaacaaaacaagaaaaaaaggaaagaaggaagaaaaaaagaaagtgaggaaggaagaagggaaggaagaaaaaatatggaagaaaggaagaatttcttttagagtagtggaaagctgtcaaaatctgcttaagaaaaccgtttgtataaaatgttttgtcttgccctccaaagctcaaagtctctggtcctgctgatggctttcctatctagaatatacagatcttccacaaattgaaaaactaaaatatagaaatatattttgtacaggtggcggatttgaaatgttttatcaaggctaaaacaggatgtatatcattataatacttttccttcacattctgctctgaatttgctcagtcagcaccattccacttaataaggcttagatcaaatcaaatcaaactttgatttgaatattacagaagagaacacatggtaggagcttgtatattctctgtctctcttactctctctcatgtctgagagagaataccttggggttgaccagctagacagtttatgagaaggtagtatctccctgttttcattctccaggaatactgaacagtgtattattgaattatatttgattaaaatatactgatggaaaagagcacttcagagtgtccaaaatggaagtaaatgtaaatctttttataatttataaataccaagtttataaaacgaatcttctcttgtagatttgtagattgtagatttctgctcatagcagaaagcagaggccaagataattttaaattatcttacttttaaaaatataattattttctaaagtgaacttaaagcaaaatctaaatacagaaaaatgcctgattacaagggtgcagctcaaagagcttttacagagttaggcacctgtgaaagcagcacagattaagaaacagcactgagcctccccacccaactcatcgccgtgtctctccatagctacatcctaacttctaattagatttctagattggatttctcaggctttgagtttctcacaagtggggtgatacagtaagttttcttttgtgccttctttttacaaatgattttttgtgaaattcattcatgttgttatgaatagttacaggtcattcattttcatagctttattgcagtccatgtgaatatagatactttgtttatccattttcctatttacagacctttgaggagtttctggagtagggttgatgctaattgtgctgcaataataatatttaacattttttggaaacatgtacacatttttagggcatatttctcagaatggaattgctgggtcatagaacatgtaaagtagatattgccagcagtttttcaaatttatatttttcaaatttatacaagtacttctagtatatgtgaattcaagtcactccacttccaaaccaacacattgtatgtttttaaaaaatatttacatttggatgagtttgtagaaatattatatttaattttgcattttttgtgtgtaatgaagttgagcatctgtttgtgtttatgctggctgtttgaatatcccatcttataaagtgccttttaaaatattttttctatatttctacttgattgcctatcatttattgaatactatagatatgtagaatatacacataaaatatctccttatatctttggccttcatttttattatgctaatagtgcctgtggattcacagaatttctccctttatttgtttgcttttgagacagggtctcactttgttactgaggctggagtacagtggcacgatctaggcttactgcaacctctgcctcccaggttcaagcagttcttgtgcctcagcctccctagtagttgggattacaggcatgtgccactaagctcagctgatttttttgtatttttagtggggacgagtttttgctatattagcaaggctggtctcgaactccttgcctcaagcaatccacctgtctcagcctcccaaagtgctgctgcgatttcagatgtgagccaccatgcaaggccagaatttcttaatttgacataacaattttgttctgttactgttaggtttgttttctaacaccctgtttaagaactatttatcccagggggaataaagttacttatcaaatttgttctgttacttatcaaatttgttctgttactgttaggtttgttttctaacatcctgtttaagaactgtttctcccagggggaataaaattatatttacttatgtaagtgttaactacatgtctcaactgtggggaaaatggattcctagataactctttgtagtactacatccattgtttgaagtgtagtgtgcataaaatttaatgaagacaatttgcattgaaaaagtcacatttctataaagccataaattaattagttctaagacttagcctacttggatgttagtaagttcagtctcagttgcttacattgtgttctcataccctgcatagaaatgatccaaatatgaataggaatttgaggtataagtgttagcagaaaaagaaaatcaggggtgctccatggcttctgtccacagtgggcactgggttggcctttgccttacctaggagatggggtggtggagtgctcaggccagttgtctgcccttgggtgctgctgtcaggaatgagactctcatctcctttcttgaagacatcagtctctgctaccttgctcctagtctcctcctcaagctcaggaaagactaaaaatccctcagatctagttggtttccacctgtaccagtctttcacatctctgtgctttgagataaagcagtaccagctctttcagtgagagttaagacactggttaaatagagtttgatcttcctgcacagtgatagcaggcattaaagatggtaacacaagttaacctttttctaaataatatcaacaactataaaagaaaattcaaaatatgaaaatattctaaaattgtatttaggataaaagtaactatggtacttggatattcactaataaatattcaggatctaaagtttattaatgctttcaaaaaaatagtacctatttttaatttttactttttttgtttttagagattgtggtctcactctgtcaaccaggtgttggagtgcagtgggacaatcatgggttactgtaccctggaactatggagctcaagtgatcctcttgcctcagcctcttgagtagctgggactacaggtgcatgctaccccaactggctcatttaaattttttttttttgtaaatattggatctggctgtgtcatctaggttggtcataaactcctagcctcaagcaattctcgtaccttggcttcccaaagcactggtattacagatgtgaacaccatgcatggccaagaaacagaatgtaatattataaagctatcaactgaagaaaatatatttgatacatatgtaaaatgtaaaacctaaaatctgattttttctcctcttcctcaccacgtgtattattccattctcacattatgataaaggactaactgatactgggtaatttgttaaaaaaagtgggggttagttgactgacagttctcagactatgcaggaagcatggctagagaggcctcaggaaacttataatcatggcagaaagtgaaggggaagcaaacacatctttcgttgtgagagcaagaggaagagagagaagggggagatgatatacacattttaaaagccagatctcatgagaattcactatcaggagaatagcaagggagaaatctgcccccatgatccaatctcctttcatcagcccctcctccaacactggggattacaatttgacatgagacttgggtagggacacagactcaaaccatatcattctgtcctggcccctcccaaatctcatgtccttctcacatttcaaaatacaatcatgtcttcccaacagtcctccaaaatcttaactcatttcagccttaatgcaaaagtccaaagttcaaagtcttatctgagataaggctagtcctttttgcctgagcctgtaaaatcaaatcgatattacttattacttacttccagcatacaatgggggtacagtcattgggtaaatgctcccatttcagaaaagagaaattggccaaaacaaagaagctacaggctccatgcaagtctaaaacccagcaggacagtcattaaatcttaaagctccaaagtaatctcttttgattccatgtttcacatccagggcatgctgatgcaaggagtggtttcccaagtccttgggcagctctgcctctgtggatctgcaggatacatggctgcttttacaggctgatattgagtacctgtggcttttccaggcacacaatacaagctgatggtgaatctactattctggggactggaggactgtggcctttttctcacagctccactaggcagttcccctgtgggaactctgtggggggcaccaacccacgttttccctctacactgccatagcaaacattctccataagggctctgcccctgcagcagacttctgcctggacatccaggcatttccatacatcctctggaatctaggctgatattcctagatgctcagcctccgagcatctgcaggcttaacaccacatagaagccctagtggcttccagcttacaccctctggcacagcagcctgaaacatatctgggacctttttagccttagctgaagctggatgcagggagcagtgtcctgagattgcacagggcagcacagccctgggcttagcccatgaaaccattcttttcttctcagtctccaggcctgtaatgggagggatggcaacaaagttctctgaaattccttcaaggcaattttcctattgtcttggctattaacatttggttcctctttatttatgcaaatttctgtagctggcttgaattcttcatcagaagatatgtttttcttttttaaaaaatttattattattatactttaagttttagggtacatgtgcacattgtgcaggttagttacatatgcatacatgtgccatgctgctgcgctgcacccactaactcgtcatctagtattaggtatatctcccaatgctatccctcccccctccccccaccccacaacagtccctggagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttctagttctagatccctgaggaatcgccacactgacttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccagtttttcatggggttttttttctcttgtaaatttgttggagttcattgtagattctggatattagccctttgtcagaggagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtgcttgcccatgcctatgtcctgaatggtagtgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaatagggaatcctttcccctttgcttgtttttctcaggtttgtcaaagatcagatagttgtagatatgtggcattatttctgagggctctgttctgttccattgttctatatctctgttttggtaccagtaccatgctgttttggttactgtagccttgtagtatagtttgaagtcaggtagtgtgatgcctccagctttgttcttttggcttaggattgacttggtgatgcgggctcttttttggttccatatgaactttaaagtagttttttccaattctgtgaagaaagtcattggtagcttgatggggatggcattgaatctgtaaattcatgatattgattcttcctacccatgagcatggaatgttcttccatttgtttgtatcctcttttatttccttgagcagtggtttgtagttctccctgaagaggtccttcacatcccttgtaaattggattcctaggtattttattctctttgaagcaattgtgaatgggacttcactcatgatttggctctctgtctgtctgttgttggtgtataagaatgcttgtgatttttgtacattgattttgtatcctgagactttgctgaagttgcttatcagcttaaggagattttgggctgagacagtggggttttctagatatacaatcatgtcgtctgcaaacagggacaatttgatttcctcttttcctaattgaataccctttatttctttttcctgcctaattgccctggccagaacttccaacactatgttgaataggagtgatgagagagggcatccctgtcttgtgccagttttcaaagggaatgcttaaagcttttgcccattcagtatgatattggctgtgggtttgtcatagatagctcttattattttgagatacgtcccatcaatacctaatttattgagagtttttagcatgaaggattgttgaattttgtcaaaggccttttctgcatctattgagataatcatgtggtttttgtctttggttctctttatatggtggattacatttattcatttgcgtatattgaaccagccttgcatcccagggatgaagcctacttgatcatggtggataagctttttgatgtgctgctggattcggtttgccagtattttactgaggatttttgcatcaatgttcatcaaggatattggtctaaaattctcttttttggttgtgtctctgcccagctttggtatcaggatgatgctggcctcatataatgagttagggaggattccttctttatctattgattggaatagtttcagaaggaatggtaccagttcctccttgtacctctggtagaatttggctgtgaatccatctggtcttggactctttttggttggtaagctattaattattgccacaatttcagatcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcatctatttgattcttctcttttttctttattagtcttgctagcggtctatcagttttgttgatccttttcaaaaaccagctcctggattcattaattttttgaagggttttttgtatctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccttctacacactgctttgagtgcgtcccagagattctggtatgttgtgtctttgttctcgttggtttcaaagaacatctttatttctgccttcatttcgttatgtacccagtagtcattcaggagcaggttgttcagtttccatgtagttgagcggtttagagtgagattcttaatcctgagttctagtttgattgcactgtggtctgagagatagtttgttataatctctgttcttttacatttgctgaggagagttttacttccaagtatgtggtcagttttggaataggtgtggtgtggtgctgaaaaaaatgtatattctgttgatttggggtggagagttctgtagatgtctattaggtccgcttgttgcagagctgagttcaattcctgggtatccttgttaactttctgtctcattgatctgtctaatgttgacagtggggtgttaaagtctcccattattaatgtgtgggagtctaagtctctttgtaggtcactcaggacttgctttatggatctgggtgctcctgtattgggtgcatatatattcaggatagttagctcttcttgttgaattgatccctttaccattatgtgatggccttctttgtctcttttgatctttgttggtttaaaatctgttttatcagagactaggattgcaacccctgcctttttttattttccatttgcttggtagatcttcctccatccttttattttgagcctatgtgtctctgcacgtgagatgggtttcctgaatacagcacactgatgggtcttgactctttatccaattttccagtctgtgtcttttaattggaccatttagtccatttacatttaaagttaatattgttatgtgtgaatttgatcctgtcattatgatgttagctggttattttgctcgttagttcatgcagtttcttcctagtcccaatggtctttacatttttgcatgattttgcagtggctggtatcggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttcttcaagaatgttgaatattggccgccactctcttctggcttgtagagtttctgccgagagatccgctgttagtctgatgggcttccctttgtgggtaacccgacctttctctctggctgcccttaacattttttcctcatttcaactttggtgaatctgaaaattatgtgtcttggcattgctcttctcgaggagtatctttgtggcgttctctgtatttcctgaatgtgaatgttggccttccttgctagattggggaagttctcctggataatatcctgcagtgttttccaacttggttccattctccctttcacttttaggtacaccaatcagacgtagatttggtcttttcacatagtcccatatttcttggaggctttgttcatttctttttattcttttttctctaaacttcccttctcgcttcatttctttcatttcatcttccatcactgataccctttcttccagttgatcgcatcgactcctgaggcttcttcattcttcatgtagttctcgagccttggctttcagctccatcagctcctttaagcacttctctgtattggttattctagttatacattcgtctaaatttttgcaaagttttcaacttctttgcctttggtttgaatttcctcctgtagctcagagtagtttgatcgtctgaagccttcttctctgaactcgtcaaagtcattctctgtccagctttattccattgctggtgaggagctgcattcctttggaggaggagagatgctctgcttttcagagtttccagttcttctgctctgttttttccccatctttgtggttttatctacttttggtctttgatgatggtgatgtatagatgggtttttggtgtggatgtcctttctgtttgttagttttccttctaacagacaggaccctcagctgcaagtctgttggagtacccggccgtgtgaggtgtcagtctgcccctgctggggggtgcctcccagttaggctgcttgggggtcaggggtcaggaacccatttgaggaggcagtctgcccattctcagatctccagctgcatgctgggagaaccactgctctcttcaaagctgtcagacagggacatttaagtctgcggaggttactgctgtcttcttgtttgtctgtgccctgcccccataggtggagcctacagaggcaggcaggcctccttgagctgtggtgggctccacccagttcgagcttcccggctgctttgtttacctaagcaagcctgggcaatggtgggtgcccctcccccagcctcactgccaccttgcagtttgatctcagactgctgtgctagcaatcagtgagactccgtgggcgtaggatcctccaagccaggtgcgggatataatctcctggtgtgccgttttttaagcccgtcggaaaagcgcagtgttcaagtgggagtgatccgattttccaggtgccatctgtcacccctttctttgactaggaaagggaactccctgaccccttgcgcttcccgagtgaggcaatgcctcgccctgcttcagcttgcgcatggtgtgcgcacccactgacctgcacccactgtctggcactccctagtgagatgaacccgatacctcagacggaaatgcagaaatcacctgtcttctgcattgctcacgctgggagctgtagaccagagctgttcctattcggccatcttcacataagatcatgtttttcttttataccacatggtcaggctgcaaattttccaatcttttatgctctgcttcccttttaaatataatttccaattttagataatttatttacttaggcatattaccgtaggctattagaatcagccaggtcatatcttgaacattttgctgcttagaaatttcttctgccagataccctaaatcattcttttcaagctcaaaattccacagatccctagaccagggcacattgctgccagtctctttgccaaagcatagctgagtgtccttttccccagtttccaatgagtttctcatctccatctgagacttccttagcctggactttattgtccatatcactattagcattttggtcacaacaatttagcaagtcacgaggaagttccaaactttccctcaccctcctgtcttcttctgagccctccaaactttttcaaattcttcccattacccagttccaagtcatttccaaattttcaggtatctggtttttttaatttttcaaaaattcagtttattgagagaagacatatatggtaaaatgcacccatttgaagtgtagagttcagtgagttttgacaaacataacctcaagccacaatgaaaatacagaatattctcatcatgcccagaaagttcccttgtaccccttggtagagagtctttccctccacacccaaccccaggcaaccacagatttgctttccgtccctatggattcgttagcttctagaattggaaataaatgaaatcgtatggcacatacttcattgtgtttggtctcttttcctgttttttgagatccacagacactgctgtgtgtattaatagtcattcatttttactgctgtgtggcattccactgttacaaacataccaaatatccatttcattcttgatggatgtcaggattattttcagtttattgatattataaataaagtagtaacagtctttgcatggacataggtttttgcttatcttggggaaataagagtcgaattgtttggtcacatggaagtgttcatctgcctttataagaatctgccaaactgttttccaaaatgattgtaccattttacattcctttttttttttttggcagggtctcattctgtcccccacactggagtgcaggggtctgatccctgcccaccgcagcctccgcctcccaggttcaagtgatcctcccaggttccagcgattgtcctgccttagtcccctgagcagctgggaccacaggcattcactaccatgtctggctgacctttccatttgtagcagagatgtgtttcgccgtgccggccaggctggcctcaaactcctaaccttaagtgatccacctgcctcgaccccgcaaattgctgggaccacaggcgtgagccactgcaccctgccccattttacattcctatcaacatgtgagcgtttcaactgctctgtatccttatcaacaatgaagactgtctcttttttattttaaccattccagcaagtatgttcagatagctcattatgggtgaatttgcatgttcctgatgaataattataccctgtgtgtgcttaatgcccacccatataccttctgtgagatgcgtgtttaaatctttcacccattgttttactgggttgcttgttttcttattattgagttctaagagttctttatatgctcgatacaagtcctttgtcctatatatgtattgtaagtattttcagagggtgtggcttgcctttttattttcttaactgtctttcaaagaaagagagtcttaaattttgatgagatcccacttatcaactttttcttttgtggcttgtgctttttgtgtcccaagaaatttttgcaaatgttcactgtttttcctgtgactactctgttgccagagccacctgcagataagacaattcctccaccttgaattatcccggtacctctgttgaaaatcaattaaccaaaagtgtgtgggttgctttctgggctccattccaccccaatggcctgcgtgccagtcctcttaccagcaccacattctcatcgctgtagctgcacacagtcttaatattggggtgagtaacttacactgttttggctactcttactcatttgtatttccatatcggttttagattcggcttctcaatttctacaaaaaaattctgctataattacaatagattgcactgaaattatcaattagtttggggagaactgatgtaacactccacgagcaaagtctacatctgtttttatttaggtcttattatttcaatgtgcatgtcctacaaatattttcttaaatttattcctccatatttcaagtttttatatgctactgaaattcctaatgaaattgaatttttaaaatttcattttccaattgtttactgctaatacacagaaatacaattggtctttgtatactgaccttgaattcttcaaacttgctaactttacttattagttctagtggcttctctgtgggttccttaggatgttttatggacactctaatgttgtcttctctatggttcccttgcttcacctcaattcctggcccacctcaattcccagtgaccctgatacccattgtaaggcagggaggcagctgctttctgtcatctgtgctgcagtagtttgggaaatgccctcagttgaaaagcagaaaacgtaaaaatgtcacgtggttcccccctgtctttcaggggtagatttatctttggtctctgcttacccttttgccaggctttctgggatcgccactgtgaacgtgtagtttagtggtcggcctgggatttgggcagttcctactcagattcgggcctcacctcttggtagttttctcgcttctgggattttcgtattaaatttccagtattcttcaagttccagactatctcctctaccatcttaggagagtaaagcctatgtctcacaccactctagtgtggagattatgaaaaacccttaggcaagagagccacaggctcccagttcaaacccactgcagctgctgctttataggagcaaactctcctccagctctggcctgcttttggacactctgaggtccctttaaataattttctgggccgggggcggtggttcacgcctgcaatcccagcacctcgggaggccaaggcgggcggatcacgagttcaggagatcgagaccatcctggccaacacggcgaaaccctgtctccactaaaaatacaaaaaattagccgggcgtgttggcgggcacctgcagccccagccactcgggaggctgaggcaggagaatggcgtgaacccgggaggcggagcctgcagcaagccgagatggtgccactgcactccagcctgggcaacagagtgactccgtgtcaaaaaaataataataatgattttctgtccaaattttatatttatctatgggacagtttgtgcaaccatggttaccagaagttaccagaagttttggctaaagccttctaaatatcttgtttctttctcctttgcgggagtgtagcttgcttcttgagtgactgcagcgagcagctgcttgcgtgcactggctgcctagtgcagccaccctgcttcacctttaagagcaggtctgtgggctccagataccagctggcaaccgcatggcctgcttcatggtatgccacggtcttctcctcaggctgcagaacctgcgttttcttctctaagcgaccaatcacttgctcaattgcctgttcgaagtgtttctgatttatggaatctgacaggtgtctcgcagcaatctacgcagcttcattacagacattagcaacatcagcacctgaaaaccctggagttaaagatgccagttttcttgccaatttctccttctccagggtactgtccagttttagtggtcggaggtgaactttgaaaatagaaccccttccttttatgtctggtagtccaataaagatttgcctgtcgaaacgccccggcctaagcagcgcagggtccaggatatccggttgattggtgctggccaaaatgacgacatttgttgttgtattaaaaccatccatctccaccagcagctggttgagtgtgtcctcctgctcattctgccctccaaagttgccttttcctgtcttccttcccaccacattggaagaggatgcaaggggcattcttccgagcaagggcaaataagtctccgactctagctgggcccacaccaacaaacatctccagaaactcggatccactaacggtgatgaaagggacattggcttttccagctgtggccttagctagcagcgtcttcccagtgcctggagggccagtgagaatggcaccctttgggatttttgctcctaggtcttgatactgctttgggtttttcaagaaattcacaaatttcatgatctctagcttggccttctcacagccacatctttgaactgcacatcaatttcatcctttaagaccttggtttctctgacactaaagagttggcccatccctcggcctgtccggccaatgccagcaggccctcttctgatggtgcagagcaagaaggcaatgatgagcaccgcgggcagcatgctcagcaggaaagagtcatcactttcagcaatgtagacaacaggcacccgattttctccttctatgcccaattcctgctgtaaagtttccagattccattcaaaggtgtccacactgccagtattaaaccaaacgtgttgcccatcaacaggagttcttcctggtgtaaaggtcactcgaacaaaacgctcgttgacaactttcagtctgtctactactccttttgaaacatagttattgacaagttccttccaagtgacttctctcccggatctcttgagcaggaagtaaaacatgactctaccccagaatagagcagtccagacgaagaacatcctgaaatccttgtcgtcccatggaaagtcacccttctggaacctggaccaccagtgagaatcatctttcttgccacctcgttttccaccgccaccacctcctccttcagaagagtgtgtggtagcagctggctttgattcttttttctgtcccataacttctttaggttcattagcatttttcccccatttttttccattaggaaagtatttttcaaatccttttgggggtcgagaacagaatatttgataagcagcaattacatctgtcaaaagagaatttctgctggcccttgcttgagttgtaataaatccataaagcgtccgaaggcagggctgctcgccagggcccatgcctgccatgcacgaagagctgctttaggccgcggggcccagcagccgacccggccccacagctgcaagcagcagcgagccatggccaccgcagtggccctcttggcccgggacgctgcgcaggcgcaagcaggcgacaacgggctgcctcgggaagcgggctccactccgggagaggctgccaggcagcgaagtgcgcccgtggctcactgcagagcgcaagctctcaaccaggtatctttatagtaatattccacttctctggtaccaattttctatatttgtctgttcttatattgctataaagaactacctaagactgggtaatttataaagaaaaaaggtttaattgactcacagttctgcaggctgtacaggaagcatgactggggagccctcaggaaacttacattcactggggaaagtgaaggagaagcaaacacatcttacatggcgggatcagaagaaagagtgagaagaaggaggggacacacacttttaaacaactagaagatattgtgagaactcactcattatcatgagaacagcaagtggggaaatgtgcccccttgatcccaccatgcccctcttccaacactgggggttacaattcaacacgagatttgggcagggacacagaccctaatcatatcatcatggatatcacctttgagaaaaacaaaggttaatcaaaaaacaattcttatcagagtatttttatttgtgttttaaatagttgtcagacaaatcttcagttagaaatcaggccaattttgacttttggtttttttctaagtttaactcctataagtatgtattaaattaaaaatatccagacatcttcaaaattgcgtgatggaaagaagtgatgcctgagtggttcactcttcattttatggccagattgaagttaaggttgtgagttatcaatgactatgatcttccttaggagaaaaaaaaatgtggcttgagtgaagcctctaatctcagtaggctaatagcctccatcactctgttcttgggtgactcatggcttcaaatccctgagttcttgcttgaaaaactttgggtttcccttctgcccacccatggctcaaatcattttatctcccctctctgacacctccttcaatgactaattttagaaaatatatttagcttattttaaacaaaatcttatttttattgaattggaactctgaacttaatttgataaattgaacttaatagggcatataaataggatatctaatataaatgaaaattcaacaaatatgcagagaggtgattcattatttgaaaaaaaaaactgcttccagcatgagaagggtaaagccatgatattctttaacttgtctgtttctttaactcatttatcacgtccaaaaacagaaaaagggtttttttctattacagttaatattgtgtttatcaataaagaattcaaaataaatatcctacatgctttggatgtcttctaggcaatcactaattgcagctaacacagaaaagatgtcatgtgttttggtgacattgttgtatttgataaaagatttttcttcattttctgcagctcctaagcccatgaccgttctgtctccttaccctagttcctcattatgacaggcagaacaagtaggacactgtgcagggaatggaaaggacactgggtggttgtaaaaggttgtctccactcccctctgtgtttgaaaaaactgaacattaagtgctgcatttaaatgcacacacacagttatactgtttgaaacaggttaaaaatgtggtgtgctttgtgatgacttcctccagagtttctcagaagtacattaatatgccaatgtactctcatttttctatgtataccaattataagataaagtgttaaaataattctgaaaaatgtaactgtaatcaattagaataattagaataaaagaccctggtgaccccatccttctgaaaacttcaaaatctgtagaaaatatacaaaaaatacacccagttttagcaaaaattactaaatcctcatagaaatttccattgatcttggacttccaagcctgtagaactgctcagagatactttcttttcttctcttccttttaaagagcttcatggtgtgagtggagtgtctgaggagtagcacctcccagcttctgcctgggcactcacctgagctgaggtgctcacttgagcagaggtgcagcttcggccaccatgggaaaaccagccctccctgggaagcacctctctcccagccttgcctagtgggggcctgggccatcctgcagggcaggtgctgctgcctcccctgcaggtctgcagctctgtattcagggctcacggctggaagcggagcctttatgctatgccctgggtggcacgggagggcaaacaggctccagggctgtgcacaacagcgcagctaggtggtccctgcctggtttcctggcctctgtaaacagaccccagaggggaccctcctcagcctcagtcacacctctgagaaatgctggggactggcatctctgccgagaggaccaggttgtctaccaaaggcccagctagcccatccctccctgcacagcaggcttatgcctggcctggaggcctggcacatacagcagcaaagggcaaacagagcagccggtaggatcgccagcaaaggcaagggtagacccagtggcagaagcctccttggtcagcggcaggcaaggttctccctcccttccctagagtggccagctgccctcacagaactagacctcccttaatcatccccccagggtggcggctgcctggggacccggtccccagcaagggcccctgatcttggctgccttcctctcgctgctgcacagagcctgcatcctcctcctcctcggatcctccttaccctcctcctctacctcctcctcctccttgtgctcctccttcttctcctcaccctcctcctcctcattctcatttccttcttgccctccccctcctcctcttcctctcactcctcctccttctgatcttctcctcctccccctccccctcctcctcctgctcctcctcccctcctcctcctccctcatcctcctccctcttcctcctcccccttcccttcctccgtctcctcttcctccccctcctcctccttcccccgtccctcctcctgcttcccctctctctcctcctcccactccttctcctgcttcccctcctcctcctccacttttccttgccctcctcgtccttgttcttgcatttgctcttctccttcacagcctttccttcctctttgcctttttcttgggctggtccttggagggaatttgcctttctaatcttccttgctgctctccttggggtctgcctcctccagccccagccttgaggtctgagcagcttctgtctgaaggccaggaggtaggactgggttgcaggggctgctgggcagggccctcttcctcctatcacatcagagatgttgtctggcacgggaaacatccaccctccgctgtgtgtcccacgcttctctctcaaagttgggttcattcatgaagaaggacagcatttagcagcggtgggcccctcagggtcgctgacaaagatgcctgctccttcttccctcctcgggtctgagagaggggccctcggcaggggcctgggcctgccccgcttctgagagcgcctgggagcccaggtgcagccctggtgggagcttcccgctcctcggcctctaggcctttgtggaggacatgtggtctctggctctgcccactgctgggtagcccggacagcgccttttgagggacctgccacctcccctgttcgtcctccctggaaagagtgatgttttgactggggttggggaccgagggtggcaggggcttcctgtggtgctgggctctgaggcccatgtcgtcctggagaactgccagggtttctgggggtgtggctctcgcccagggcctccccagattgtggctgttccgctgtggccttggcttccactatctttgtgtccctgggggtgggtgtgtggccgtttctgccaggaatatggagtccaggtgggtgctgggaaccaagtcctccacattctggacttttgctgaggcttctgcagccggggccagctctggaggtgaaggggctgcattggccgcgtgatgtcccagacagcctggaggtgacgctgcgcggtggggcggggtgaccagacgggccccagcggcatgtgggagccggcagggtctccgaccctgggatgttgaggacgaagaggacggtggcggacgggggacaggctgatggggcattgaggggccgctgtgggggcgggcggggtgagggggtctggagctccgggtggacactgcgctcagaagcgtcactggctcctgggaggccaaggaccggctttgcctgttggccgccagcggggacgcggagctgcggctgggagcccccacgtggaggaaagtgcaatgcttctggtcctcagtctcctgctgcaccaccgctcctccagcgtggagtccacctccaactgctttttctccctctgaagctgcaaaaatggaatattgaaaaattcgtgaaggtgctttaggcccgagctgttcttcctggaagactcggcggaggggaacaggaggagcggcctcagcaggatgactcccactggctcctgtcccgcagtccccaggacgcacacctgcgcgtgggcagcactttctgaagccccagagaatgcacttgaaggcgcactgcttggtgatggggatcacctggccagccggtggcagttcttgggcacgtccaggaacttgcatccaggtccattttggactccgcctccttgggttgttctccacctgcaagccccggtctggctgtttgcattttccaccctccactacctccgagacttcaactctcacgacgtcttcagtggtggggtggttcccgtagatgctgtggcctggatccctgcgtggggatatccacctccaccaaatgcttgccctgcggaccgtgcctcagcgcggtggggcgggtggccccgtctcccggatagccatcttcatgttttcacgccacggcgaagcgcctccgtggcctcagctcctggcctgcagcacgcaggggatgttcttgtccccgccggggcctgctccgaccccaccagcttcttcagggcgggaaccatctttctactgggacgtccgagcccggtggcggccgggaagctcagcggcagcggcggagcagctcgactcgcactgtgtccccgcgggacaggcctcccgctaggcccgggacccacggcgccacgcggcctccagccagggctcccgacctcagcgcagctccgccatgtcctgcggcctccggagccgccgcctccagccctcggcgccgccacctgggagccggctgcgcagggcgccagcgaaaatcgcatttctgcttagaagccacccagttcacggtgttgtgttatggcggcctgaacggactgaagcacatagtgactatgtctgtgctcgcttttaaatttacttttatctttttaaaatttttattagttttcccggaaatcttgatgttttacatagcctcaaattccttcttggcaaagttatacttgctaaatatttagtagtttcagcaactgtctgaaaagacacaattatgctgctaaaaaaacaaggaagaaagaagagacagcaacagacagagtttgagaatttgaattttctatacacacagattaaattttgcaaataatgtttctcttcttttctgttgaagtaaaaacacccaaactttcctgtatatatttgtacaactgaaatcccccctggactgtcacccttgccctaactaaaaaatcagttatattctagaaaatgagaaagaaaatataatgaagataaaaacatgtattaaacatggttatctgaacggactgaagcacatagtgactatgtctgtgctcacttttaaatttacttttatctttttaaaatttttattcgttttccccggaatcttgatgttttacatagcctcaaattccttcttggcaaagttatacttgctaaatatttagtagtttcagcaattgtctgaaaagacacaattatgctgctaaaaaaacaatgaagaaagaagagacagagcaagagacagagtttgagaatttgaattttctatacacatagattaaattttccaaataatgtttctcttcttcttttctgttgaagtaaaaacactcaaactttcctgtatatatttgtacaactgaaatcccccctagactgtcacccttgccctaactaaaaaatcagctatattctagaaaatgagaaagaaaatataatgaagataaaaacatgtattaaacaaaaatgcagtgataaaatcgtgagtttcaaaataccctgtgagctttgtttgttaagtccagggaaagagtaacaaagataggcattaggtgtgcaggtcatttacatgtgtttatgtggccatgtctaccattttctctttaacttttcataacgtggaactcatttctttaggtagaagttatgagttaactatcttggtagtgtttaaagaacaagcattctttaaaagtccattctttttcttcatttttgaatatgcatagcattacagaaaaattggaaagtaaaccagaaaaatacccataatctcaccattccaatacaatgctgtctgtgctttttcaaaaaaaagggacctcaatttctaaacttagagaaaaatctctagcttttgaatttttttatattctgaatttttgatgaagagttatgaatttttgatgaagaagtatttgtttactgcctctagcattgtattttaaaagagaccggtcaaaatttgattttaaaacaaaggattaagaactcttccatttgtgcttattttacatctatcaggtgagagtaaaatcactgatttaaagacctctgagttttcacaacacaaggaaaaataaatagacaccacccttactgttttgtacattccactgaaatataagttccttgtggacaggggttttcatctgttttatttgctgctgtatcccagtacctggcacctagtgccacgtaggaagtactcaagtacttgttgactgagctaattaaaatagtttcaccatagcagaattgcctttattctgtgggggcgacccatgtaagtttatcttttatgtcaaaaatgccattttaatgcatttatgaacatcttcaaattgcatcataggttttgttaatttttttaactagagtacttcagacatattttgcctgctgactcaatggtgtcattatgaatattactataatttttaggtgggccagtgaagcttgtgttaattaccatgaactgttgttttgatgacttggaatagattaggatgaatgttgtaaaggtttttctatttctgctggaatcttctgtcattctactcatcatcatctaggtaatggtctaaggctggcaccatttctcttatcaagtaacgcaaatggactttttggcagatagttgttgtttaacaacttttgtttttagtttcagagactatgttctggaatgttgagatttcttcatacatgacctctagagaaataggcatattataaaatgagttacactgtgtaactgagggcatgtgctgatggcaaaattattatcttcaagaattttttttttagtgttctgcatttgcccacactgttagaaatggaatgttagagaatatttattattttgttgctatcaaagcaaaatttgcagaaacttgaatttattgtaattactgtattaactctgaaatgcatggctatgttttaagggaggtttttgccttccatattgttctcgttctactttttcttttactcagaaggacttaatctctaaacattagaaaatgttttatacagagacaggtctcactgactacaattagaattataagaatctcttcatttgtattagttgataaaagtattttttcctgtttttagataacagtcctccaaaatttatattactattatcaattcacttcttaagataagcacaatgaagtagtgcctctgggtgttaggattatgtagttttaacatttacattgattatctgtattttctactaaaaaaaaaagcctatacgatttaatcaatatgttaccaatagataacaaaagtatagaatactgtttctgctcctttaatagcgagactttactctaatttcatggtggttctaaggtagtagtaagatgcaaaaaagaggtgcagatgtgacaagaaaagtgagcaaaaagtaataatgaacccacttaagaaattacatgtctgtataagtattaaagataaagcttaggcagggcgtggtggctcaggcctgtaatcccagcactttgggaggccaaggagagtggatcactcgaggtcaggagttcaagaccagcctggcgccaacatggtgaaaccccgtgttgaataaaaatacaaaaattagccaggaatggtggggcgcgcctgtaatcccagctacttgggaggctgaggcaggagaatcacttgaacccgggaggtggaggttgcagtgagccgagagctccccattgcactccagcctgggcgacaagagggaaactatgtctcaaaataaataaatacataaataagaagaaataaaaaggttaaggatctgacacagaaatgcacacattttcttctcaactatcaaaagcaggaggaaaatttttaaacttcccagagatgagttttctaagttttattttccaaacttcactcttattaacctttaaaacaacactggtagatcatttctgaagtgaagttttaaaatattcccttcactgtctgaaagcaaaatataacccttagttttatcaatttgtaatttttagttaaagaaacaacttgataatggggactaagggaaataaagtttctctgcgggagtccctgctgaatgccgccctgagctagcgggcgacgctgcgcttccccgctggagggcgccatcatcccatccacagagagctcagcaggccacgtgccgcggcctgctgcgaacccgcagggactgctccctggctggcggcacccttattgttcaataaagacctggttcagagacaaaggtggccctgtcagtagctctgaatagccccaagctagttgctgatcctaacaggcccaattaactgctactcatttagcaaagcggcccgggacccatcccgcttcccgctccaccttctgaaactctccctgcctgggtaccttggctatgggctttgcagtctccctttagcggatcaaaggtgtgtgggaaagaatgacggctggatccgcctccacaggtccttacacagacgcacacatcacagccagacccaaagcactcatggtggtgagcgagagcccgaggtggaattccagggccggtctcagaacaacgccttgattgccgtgattcgaagagctatctcaaaacatttcgcttcagtgaagtgcctgagaagaaacactcgtcacaactcactctgctgctgacactggatgtactcaccttaggtcctcccactgccaggctgcctggcctcgggaacacgctgacacacacaagaatacacactggagctggcttccttcctcctcacaactaagtatattcctgttctagaagtcccccaggatcatgttagacaatgtgggaaacagacgggcagaaacagaaagggaagaaagagaacccaatgtccccatgcaacaattagactttggtgatggaattttctcatattatagaaggtgccttgtcaacatcatgggtagtgacaatataatattctatactgttctcattcatttcccattctctaatacctgtggccacttggttttttaattttttgtcattatgagcattattgtacataaaaatttccccatatttttgggtaatttacttatttttccttttttttgttttttttttttttggagacggtgttttgctcttgttgcccaagctgtatgtagtgcagtagtgcgatctcagctcactgcaacttctgcctcccgggttcaagcgattcttctgcctcagcctcccaagtagctgggattacatgcatgcaccaccacgccctgctaactgtatagttttagtagagacggggtttctccatgttggtcaggctggtctcgaactcctgacctcaggtgatccacctgcctcagtctcccaaagggctgggatgacaggcatgagccatttttgggtaattttcttagaatttattttgaaagcaaaattaagtcaaatttcagcctaatcaaaactaggtaaaaagatgctaggtcaagggatattgatacatgttgctaaattgttttccaacagaattggaacatcttttttttctgcccagcaatcattgacaccagtttatcagatatccaccagcaatgtgttatccttttttggaaatatttatacaattttatgttagactattactgtaattaaactttcccacgtgcttgttaacagtatgtggaaattttccatgtgtttcatcaacttgccgtgtccataacaatttttctaattgattgcctgattgctttatatagcataaatatttcctgttgtttcattcaattttgattttttgtagatacatctattttttcatttttaggtagttaaatatatcagttttttaatttattctatttattaaccttggttatttgttatttttatgtattttacttttcaaatttatttggaatccagcttctgaaggtacaaattattttctgtataccaaagcaatgaacatttcatgtgtcattttagtaaaatgttttatttccttttggatatatactacgaataggattgctatatcagatggtagttctgtatcaagttctttgagaaatctccaaactgttttccacagtggctgaactactttgcattcccaccaacagtgtataagtgttcccttttctccccagcctcaccagcgtctattgtttcttggcttttgcatagtagccattctgactagtgtgagatggtatttcattgtagttttgatttgcatttctttgatcagtgatgttgagcattttttcatgtgtttgttggccgcttgtatgtcatcttttgaaaagtgcctgtttctgtcttttgtccactttttaattggcttatttggtttttgcttgttgaatgaagttccttatagattctggatattagacctctgttggatgcatagtttgtgaatatgttctcccattctgtatgttgtctgtttgctctgttgatagtttcttttgctgtgcagatgctcttcaggttaagcaggtcccacttgtcaatatacattttcattgcaattgcttttgaggacttactcataaattctttcccaaggccaatgtccagaatgatgtttcctaggttttcttctaggattcttatagtttgagatcttacatttaaatcttaaatccatcttgagttaatttttgtatatgatgaaaggcaggggtctagtttcattcttctgcatagagctagccagctatcccagcaacatttattgaataagtagtcctttccccattgcttatttttgttgactttgtcaaggaccagatggctgtaggtgtgcagctttatttcttggttctctgttccactgggctatgttgttttgttttgttttgttttttaccagcaccatgctcttttgatatagtttgaagccaggtaatatgatactgatacctccagctttgttctttttgcttaggattgctttggctatttgggcttttttttggttccatatgaattttaggatatcaacttgggttacatcagtggtggattggataaagaatatgtggtacatatgcaccgtggaatactacacgcagccaaaagaaatagtgaagtcatgtcctttgtagcaatatggatgcaactagaggccattatcctaagccaattaacacaggcacagaaaaccaaatactgcatgttcttacttatgaaaggaagctaaatactgagtactaatggacacaaagatggcaacaatagatactggagactaatagagggaggagggctggagtgggggaaggattgaaaaactaacctgggtactatcctcactatctgggtgatggaatcgttaatatcctaaacttcagtgtcaggtgatctacccatgtaacaaacctgcacatgtactccctgaatctaaaagaaaagttgaaattgttttaaaaaattgttgaaagaaaaaaaaataataagtatgaagaacatttcttaacagtattttgtagtccatctcttccccactgatgtggatgactttcttcaagtatcttaagttttatgtaactataatctacgtctgaatgatatgtcctcttcttttttcttttgttctccagcaacttttcttggtcaaagaatgcagaaggatatatggtgtctgtggtttaattaacaggattgtttgtaaaacaactttacatttatcttatttttaaaattcttgcttttgaatagctgatgtattagaatagacactctcctatcccatgcaaaaagctgttaaaaaatgagcagcttgcaaatctatcataaatgagacattgaataaagcattcttacagtgagggctaaggagcagttcagtctagaatttgcttcagatactttttgaaataaaatattcaaggcataaaaaagcaaaactcgaaatatctaaaacagatacctactgatatttttaccctagtctcttcccacagtttttatgtgtctctgtgctccactgattcaaacaaacaacaagagcagtaggcatcttctaactaaaagttaatttactagtcttcaactaaaaagtcacagtggaagaacatatgtaaggtgaagaaagctttttaacctttcagacttaaataatactgtatttcaactttaaagaaaggctccactatatattttctgcattgacattttaaaatatatgaacaagtctttgtggtacaatatatacttcaatatatccaatataccttatatgaattaaaaacatgtcaacttgataactgtagtaaggcatttaagtattcagaggagccataaagaaatttcttaatgagtgctgtccttttaatattaactggatttagtaggtttccttaaaatgaacaggaaacaggccgggcgcggtggctcacgcctgtaatcccagcactttgggaggcctttggcaaattagaccccaccccatctgagacttcacctcctgcaactctgccgtccaccacccttactctagccacattactgccaagcataatcttaccatagggcctttgaacgggctatgcctccaccagaaccacttttcccgtttatctgatcactccttcaccttcaagtcttgatcaaatgacagcttcacagtgacaactttccagtccatcgtaatacagattatgcttcccctctactcagccccaccccttgatatctgctttattttcctttatatgacttatcactttctaactttttaaatatttcagatatttgtgatgtttgttgtttgttggctccccctaaaatgtatgatccaagaatgctgggattgctgcttgttctgtttcctgctgtatcccaagcacacattaaatctctttggtgtaagactcaatgacttaaatacttttcaattttatctcttgacttggtttgatcatccatatttttttcattcaaaaggaaaacacttctataatgtcactattgatacttttttcatgaataaatttgttttcaaacagttttactgtactttattttctatcttgtgaatgtttgaacaacactttcaattctttattcagcgttttggagatttggtgtttacaaatgttgtttttacttctgaaattaattttattgccaaaatatattttatcaacctcaagaagtaattgttgattattcctatggagaatttgccaggtgaataatatttctcccatgatcttttctcactttcctcccttatttaattgaaattatcttgaactagcagacccatttttaaattttataattatgaatatcaatatacatgtcttcttaaatcatgtttaattagctttgttttggaaagcgtttatgactataaccattgatctacatataattacatgtttatatggttccaatgcttgtcacaaacctttctactacttgttttattcctgcttctttgaaattcatcatagttttttatgtaattctcaaaggtacatttttttaaaggaaaactatgggagataagtttatttaattccttgctcctataatcttatcaatggaacaataactttgctaggcatgcagttattaggtaacaatgtttcctttctctggcctctttttgtgtgccaattctgagttctggagatatggttccctcctctcctagtattcaatgcatggagggtatccctgccttcccttcttctagtagataatttttgatagtggtaatctttgtgattgttgtttttctatctagaagtttgcattatttcttcttctccttcgtcaactcctcctttttcttcttttttttccaaaactcaacttcttaataatttgtactagtaccaaaaagcttctttactttaaggtatgagagatttccttacgtttaactcacttttccacatacatatttctgattgttgcttctgccctttttcattcttgcctctttttttatttaacttatcttgtttgttctttcattctttatcctgaaatatttcttcatatactgatgatgtatttatatcctgatctttcccttattaaagtccataatttttaccttaatctttgtttctaatttcatacatatccttttatatttctaccttcatctaatctatctccttgtgttatcttcttgtcttttatttctcatatattaggactcttatttgcaagtgacagaaactgaagctgcactgagccgagcatacaggagcttaatggtttataatcctaaaacattataatagcgtgtggagtaccaatgcaataacacatcaattacaccatgaacacaccattaaaaatgagaatttgtaggacactcaagagacatataaaatgctaccctactagagaaaaatgtgataatattaaatataggctaaaaaagattcctactgtcaaaaaagttggttattttacatctatcccaagtttaagtctggtcataattacccaaaaataaatttaacaaacaggtcccagagttcacctaatgaataaaaatggcttagcggagttttggttaaaaaccctgtagaagttgcatttcaaacatccactaaatcacagatgttactgaattattgggccacccattgaaatacctagcagatgatatggtccataagcatcccagacatttaagaagtatagtgaaccaaactctcaatcaacagaagactaatcacccggccaattaatttgtgtaggctaaggctaaacttacatcaagctccaatactgtgtattctgtgaagatcaatagagaaagatcttcttcccttcttgtcctcaccctactctggacctctgggttcccaatcccctgaaggcaaatatccattattattgtggctcaatttgtactttgacaaatattgacatctatttcaaagagactgcaaagaaatctggtgttcctctgagttttgttttcatcttgcctttctcaagcataaattaagatattatgttaaatgtttgtttttgtagcctaattacactgaatacactgtcgtcgatagtgtttacatactgcaagctacttaacatattatatatagtaggaaagatgtgtttaaatatgtttgcatggcttaaacttgtatatctcaaaaatagtcttgaattgttatcaagcattgccattagtatgcttttttcagttctaatcaaaatatatcattttattatgctttccagttttactctagaaaatgttgaactgtaactgcacattcaagtctaatgtactgcttcaaaagcaatttgagcgatcttttatctataaatattataatttggtgatggtgtatgtggaacagaaaatgcttgttcaggatgtggcaaatacagccacctgcctgggacagttcacggaggcaggaagactccaggctggaggggaaattaggggatgcttccgagggcaggaggcagacataaagaaaaatcgtggaggtgatgtgggagcataattcatggctttgggtgccaggaaaggaggtgaaaatcctaggaaaatccaagtagggtgaatgagattgcagcaaatccataacactattgaaaggggaatcccctgttctctagagtttaaaggcccttgtttattcactgagagttgtcaggctaattatgggctctggttttctgctccttgagggaagtggcctcttgactcataatactaacaataaacaactccactttgtagggcttgagttgagttacggtttttattttagagaaatggaatttttcccctaatactcagacccagacctgtcacagatttcggtggtttcacagagactcctccaagtctacggcactcttggtcgctttgctttatggcaacaacatgccctccatctacttgattttctttcacttggtttggtgaaatagaaacgtgatgctgaggcctgtgttagttgagagttatgttcttggagtggcaagactcagggtccagggcatctgctcttggagtagctcccttgtgacccggatatttgccgctaggcgatctttccaggtcagcatctcacgtgcaggagacactcgtccgttcgatgcctctgaccgcaccgtccttgcttctagtctcacctggacaccaggagctgcctcttgctatcagcactcaaagcagatgcagccgtttggtgcctgtgcaaggttgcaagtgtgtggttggatgggaggcttctcctcgaccccctggtcccatgtctcatgcatagaagaggaaagtcagggccagaggtcacctggcccgttgaaggtccttactccaggagcagatcctcaatgggagtccagatttcaggtgcacaaggcgtgcggtctttcggcagctcacgccaccatgcacgtggtgtgtttctgctccatgcttctcctacggaggccattccaccgccatggcgtaaccagggaggtgggcgaggccagggccagttcctcacagtcgggggaactaagggacctgactccagcaggtcctggattaccttgatgcatcccagggggagaggttgtgttctgaagattggaggagtgtttgatttatttacatgggatttgttgcaatacatgttgtgaataaattttctttataactgtttcagtataagtagatactgattatctataagaaaattctacaatcctttcaaaagtactaagtaaaataagaagtagaaagtgttatctcggccgggcgcagtggctcacgcctgtaatcccagcactttgggaggccgaggcgggcggatcacgaggtcaagagatggagaccgtcctggctgacatggtgaaatcccgtctttattaaaaatacaaaaattagccaggcgtgttggtgcatgcctgtagtcccagctactgcagaggctgaggcaggagaatcgcttgaacctgggaggcggagggttgcagtgagccgagattgggccactgcactccagctggtgacagagaatgactctgtctcaaacaaacaaacaaacaaacaaacaaaaaaccaaaaaagtgttatctcttgaaatttttaactctgaaaatccaccctctgcacatcttacatagaacaagacaggcagccacaatgtgccatatgtgttgatataataccgcttaatgccagcacgtgtaagatctgtgtcccttctctgtgttccaatgagcagacaaagcttcaaaacattagaaatgtagaaagaacttaaacttattgcaacttactctttattcccactgctaatcacactttgtcatctgatttttatgtaatttttcttccaggtggcctttagcttgaaactcaattgtatagaaataaagtatattattttatataagatatgcctttaaattgatattacatgttcatgttacattcaatagggagcgactttattcttggcacaaacagtccctgaaaacattaagctcactgttgacctcaatcgtggtcattgttttcttgtgtgtatttgttgcacaatgactttaaatataatgtctgaaaaatcacagcatggggctgtgaatactggttgccctgtatagctggagatttatagctcctgtcagtctcccagggatctctgagatggatttaaggtgtgagtggtctccacactttctgggcggctttctcttctctacccagtgaaaccgactgctgtgatgagctggggttggagctgtggctggggctgtcaagatactcttgttactatgatcaatcacagccaggtccatgaagcagttgctagttgagctcagcaatgggattagccccttttttcaagtacttatttagttttataaattttagttgacaaaaatatatatttaaggtgtacaatatgatgttttgaaataagaatactttgtggaatagctaaatcaagctaattaacatatgcattacctcacattttttgtcgtgagaacaatgaaatctactcttagcaattttcgagaatatgatacattgctattacctgtagccaccgtgaagtgcaatagagctcttaaacttgctcctcctccttgtctgaaattttgtaccttttgtccaacctctctcaattctgtccctcagccccatcctccgcagcctcccttccactctctactcccataagtttgagtgtcttcaggtaggtgagatcttagggtgctcggcttcatgcatctggcttatgtcacttaataccatgcattcagggttcagccctgctgccagagacagcagggtttgcttcttgtttaaggatgaacatcgctgctgtgttcatgttccaccccattatctgtgtgtcagctgatggatgcttagggtgattccatgtcgtgtttgtttctgtgaacgatctcattgatgcctcatgcatgccacctgagtcccgcatgtctggtgctctctgcctctgaaatccctggccagcatccgggcacgggggcctgcagggcagatcccagccccactgcctccagagtctccacactgagcaccttgcagcctgccctcctggcacagctgcctccaggaggagccgctatgggaacgtttttgttctcagtaatttaaggtgcttgctgagagcctgatgagaaggaatttgtagcataggaagcctctggtgaaatttctccttggcattattgggaccaaatccccatagtgtcacattgaagtcaacgcaacaaatgtgaactgaaatgtcgcagtgtacccgatcctgtggcccccgagtgccctgtcgctgatggtccggtgttctgggtgcggaccaaggaggagccggtggcaaaggcgcctcaggcaggccctgggctccatgggcggcttgtgctccgcgattttgaggccatttgcagcagctccgccagcccaccgctctgagctgcagccgctgccagccacaacagcaccaccacgagtgtcttgggggctttcttcagaggaggctgtcagcgtcctcaagttccaggcgctctagcctgctacaacaggctttttcccacctgcggcctctcctcaatggcctaaaagcttggccaactcccacaaagtttggcagtaacacaggctgtcactgacatttgtggcgccaggacttgcccacgcgggttgcaaacgtcagccactgtctgtgtcacgtgcagtgacgccgcccgaggtgcgcacggtgcgcacaccgcacgcgcacgcccacgtaacggcttggctgggcacccccgcttggcttggtggtcctggtttggattggctttaccctggcattcctttgctgggcttgaccttttcttgctgggcttggcattcccctggctgggctgggtgtttccccggtggggcgtgcactttccctgggtggtggagggggcgtgggctctccccgggtggtggggggacgtgggatctccccagttggtggtgggggaggggtcgtgggctctcccagggtggggttttggctgggattgacctttctcccctaacagattggaaactcgtaatttcccgctttttggtgaaactcgttgacagacaccatctgctcgctactaccaggctgttgaaagcagatggtggctgaggtttctccaaagctggctgcctcccctatgaagaagccctttggcttcaggggcaagatgggcaagtggtgctgctgctgcttcccctgctgcaggggaagcggcaagaacaacatgggtgcttggagagaccacgacgacagcgccttcacggagccaaggtatcacgtccgtcgagaagatctgggcaagctccacagagctgcctggtggggtgaagtccccagagcggatctcatcgtcatgctcaggggccctggcattaacaaaagggacaagaagaagaggtaaccgggcctggggctgggaggaggcgggaccttgggggatggggttggacgtgccctcgtgtgtgtgtgtgtgtttgtggggggcgccctggctttcttgcctcctcaggtcccacgccacccggtgtgtggatacttcagagagctcggggcacaggcctctttatgagcagcaacacaaaaacaaaactttagttgatttccaatcccataataatttcccttatggaacacttaagagactgttttaaagtgatttaactctcaaaattaagtcgatgcagcagattatttttaatgtacacattttaaaacaatgttatatacattatagaaaggagtataatgagaactaagtcccataatatatcaaattctgagattaaatattcttcagataaaatccaatatgcattttatatcaatgtacccctatgtaaatatgttctttactgaggaaccttagaaggaaactgaaatgggaagatagttcgtgtccttgaataggaagatttatttttcttaagatgtgagctcttttgtgtttatcacttttacccaagccaaataaaaatagtaaagttttaacattttaaaattacacatgctgtcttttactattgtgataaatgtttgtgacagaatggaaaaagacttgctcttccagatatcaaaatgttcatgtgctatttccacaaattgtttactaacagctcaaaagacataaataaatagaacagaatacaaaatccagaaatacccaaatatatgaatttagaacttgatagtggtgatgtttcatagtagtataaaaagatgaattattcataaatgaaatgcatgctgtttggagaaaactagctagattttttatgtcacaaaaataagttcctggggtatacattaaaaattttaaatatacaaattaagaaaagtgccagaaggaaacacaaatgtctatttttatatgcagatatattttatgttcacagagacctaagaacctcaaaaacaagtattctgaagggtggtttggcaaaataaaaattaaaacaccctgtaaataagaaaaaaattaacaaaggacaaaacacttgcaaaacatgtattttcattttacagagaattctttcaaatcaacaagaagacaactaaataaaacaagctcaatttaaaattgggcaaagtacttttttgcatgtctaccaatgacctatgcacataggagaacatagtgttcctgataagagaaggaatttaaattagaagagaaatgaaatactcttttctatctaagttagaagaggaatgaaattctgtttctatccacaaagtttgtgaggatgaagaacagtggtacttatacagcttcttaaggtttaagttgctgtgagttttcaaatagacattttggtggtaagaaccacattttaaaaatgtatatgccttttacccatcaattccattatactgaaatatcttttggaaatagatacatctgcttttcttagtattacttaaatagcagtgtattgagaagaactcatgtaaagattttatgaacaaatttcagtccatccatatgatggaataatatgtaaccattgagggtgtcaatagatacagagataagttgacatgcaaagatgtacttaggtatatatcaagtgagaaaaaaatcagttatacgcaaacagaatctgctcttgtgttagctgaaaatatgtcaaaaatatgataaaacttatttctggggatttgtattgtaagtgaagtttttccctttatcttatctgcgatttctgcgatgaacgtctgaaaagttttagttaagtttcactagtaatgaaataatccttgggaagagaaggagtatgctatttgcataaatacaactaatttctcacattctagtatttatttttctttctgtggatgcgtatcttctgtgaatttttttttttttcgacacggagtctcactctgtcacctaggctggagtggggtggtgcgatcttggctcactgcaacctctgcctcctgggttcaagtggttatcctgcctcagcctcctgagtagctgggattacaggcacgtgccactacgccatgctaatttttgtatttttagtagagatggggtttcaccatggtggtcaggctggtctcgaactactgacctcttgatctgcctgcctcggcttcccaaagtgctgagattacaggggtgagccaccatgcctggcctcttctgtgaactttcattcttttcagaagtagagggaatctgtttacctgttactgtagattttattgtgtatatattttattatataattatcttttcattgtatatagattaacatgtgtaagaagtatggattaattattttagttatatatgaaaattaaaatagcaaatataaatgattattactattgtgaatgtattgctgtactatacaggagttttctttgaaaatattgaattcttcagctgtgtttatcaattctttcaatcgatttattcatcaaacataagccagacacctattatgtggcaggcatattctactatctcttaggatccttctatctttgaaaatttcatgtttccctgccaggcctgagcaaactgagagatttaaaattggactattaggacttaatctcaattgacgcttttcctctctcctttcagaaaaaagcgtttcggaaggtagaaaataataaaacgtaaactttaactgcctttttgaaaatttataacagtcacgggtaaagactagtttaggacttttaagaactaaaacatgatacttaaacagcgtggaatattatgcagccatagaaaaagaacaagagcatgtcctttgccagtgacttggatggagctgcaggccattattcttagcaaactaacccaggaatagaaaaccaaatactgcatgttctcacttacaggtgggagctaaatggtaagaatgcacagacacgtagaggggagcaacacacactggggcctatcagagggtggaggatgggaggaaggaaagaagcaggaaataaaactaatgggtactgggcttaatacctgtgtgatgaaataacctgtacaactaatgcccttggcacacgtctgcctatgtaacaaacctgcacaccctgcagatgtacccctgaatataaaagttgaaaaaaaattccacaaatagtttcataaatccattttaaaaaataaaatttataacaatcttaaatcctaatattaatgattgtaaatatctgatttacatacattctacaaatctaagtattgaaaaaaattagctacacctattcatttgaattccatgttttctttggcttaaagatttttgaacaccaaagtaagaattagtttattttagaaatttgtttttgttttcacctcagccctcttaatgtgtagttcttttaagaactaaaattcatctaaatgtcagtcatctgaccagaactgccccagacctgttatagataccatattctacttaatgtaaggcaccatagattttatgatgccccattattttatgtcacaagaagagagttatttaaatgctgccaattatagtaaattgtgaattataagcggtattccagtgtaagaaatgtgaaaacatggagacaatgaacatcttagaatcaataaaatacaatgttatctgtaatctttaagacatatctcaaagtgtaggtgtaattgtatcatgtcacttatttcaaatagtcttcattaagtagtagtattaatacaaattataatatctgacaattattgagctgttatttgtgttaggaactattctacatattttgtgtagagtctcatttaagcattatagtggttttctgtgagaaagctattttttgcatccccattttattgatgacgaaattgagacacaaaaagactaagcaacagctaggaagtgacagagcttaaaacagttttccagctcaagttgaatggaatccaagggctgcgctctttctgttctgatactctgctctttcattaacacagtgagaataagaggtaataaatagtgtgctttcttcacaggaatattaaatatttgttttgaaggctgggatagcatgctattcagcatttgcaattacatgagtcattggtatggctttagatagtgcattacaatttcctaaaaaagtctctcactctcttaggactgctctacacttggcctgtgccaatggcaattcagaagtagtaagtcttctgctggacagacaatgtcaacttcatgtctttgacagcaaaaagaggacagctctgataaaggtatgcagtagccaactatatcagcatgaggtagatttaagataattaaaaaaatgagttttctcatgtaaatataacttggtgaaatctgtggaatgtttattttgaattcctaggatttacaattgatttcttggtctaatactgacaggccgtacaatgccaggaggatgaatgtgcgttaatgttgctacaacatggcactgatccaaatcttccagatatgtatgggaatactgctctacactatgcagtctacaatgaagataaattaatggccaaaacactgcttttatacggtgctgacattgaatcaaaaaacaaggtacagatctaccaattttattttcaaaatactgaaatacatttgttttaacatcgacttgtgtaagggtcagtttgccatatttggaagctcaagcataacctgaatgaaaatattttgaaatgacttaattatctaagatttaattttaaatattgttacttttaaagaggcatcagcaggtacagctttttttatgcacttgtggtaaaatttttttgaaaacactgaatttgtaaaaggtaatacttattttttttcaatttttcccttccaggttttcttttccctaatcaatgtaaaatgacaaaatttgccctggaagcaagtttttcattaaaactccaagaaaactaaaacatgtttcagtgaatagaaatcttgctgctttggcaagttcctaaaaaaaaaaaagtaatagatatgaagcgatgtatcttttagtggcaaggcttaagatatttctgattccttataaggcagaaatagaaaatgaaaaggagagcaatcagaaatatcgaggccaatttggaaattaggtaatggaggaaaaagaccatgaagagattctgtgtgtgtgtgcttttttttgttgtttgttcatttctttcctttgcgtggtgaaacaaggttctcttcagttttagagaatgacagttttttagtttgggagagggagttagtgggttgtaaactgcctagagattaattttaggagccctctgaggaagcagattggcagtgaataggtggtatgtaatgggaaacccttgagcagagggaatatcagggaattatttgacttattatcctattctggtagaaatggccacttagatagagtctaaactctgctttcaaatctagaatgtcttgatgggaaggtgggagataaagagcttataagtaataagatcaagttggattttgagtttactaggccctgttctaaccccatccaggaaaattaagtggtgttttcagcaaatgagtctctcactctttccttttttttggccaaaagctcaaatgataaagggaattggccatgtgggtgagagatgagactgaagtaattgtctgttgcactagttttcaactagaagtgtgcatctcagtaacttgaggaacattttaaaataatctacaagcctagaccctctcctgaagattttgatacagtaagtctaataaagcctggatatgtccatttaaaaatgtttccttgaaggcaggcatgctggttatggatgccttcctcccagctgctagagaggctgaggtgggaggattgattgagctcaagagtttgaatctagcctggacaacataatgagaccatgtctgtaacaacaatgacagcaacaacaacaacaacaacaacaacaacaaattccttaaaatgcagatacacttctgcttaagaaccactgaatagataagtgtaatatgtaaattctcatatctcagaaacttaagacatctctagaagagttggagttggatatgcgcaatttcctttaaatctttcctttccaataatattagtttgactttctctttctttctttctttctttcttctttctttctttttttctttctttctttctttctttctttctttctttctttctttctttctttctttctttctttcttctttcttctttctttcttctttctttctttctttttttctttctctctctctttctctttctctctttctttctttctttctttctttctttctttctttctttctttctttctttctttctttctttctttctttctgactgggtctcacattgtttcccaggctggagcacagtggtgcaatcacagctcactgcaggcttgacctccccaagtacaggtggtcctcccacctccagtttgtattttatttatttatttatttttttagtagagatgggttttttgccatgtttcccaggctggtcttgaattcctgtggtcaagcgattcagctgcctcagtgtcccaaaatgctaggattacagttgtgagccaccatgcctagcctagtctgactttcttctctgtggttgggacattaaaatgaatattattggtagtatctatcagcttacagaataataccttttccttcctaccatcagttattcactgccattcagaaggtctttagaaatttgcagtgagtattctttcaataagtagaggctggccctctcaggattttgtgtctctttgttattcaagtgcttaagtcagtaagtcattactaagagcagagttttctcaattaaaattgtagcaaattccaaaccatttttgtcaattaaagccatattatggactatccagtatgtctcttaagtttgtagaactttggcataatcaggatggtagtattaaacactaaaaaccatgcagttattaagaatacacatgggaattctgttaatttagtttcagcagtcctatgaactgattatttagttaacaatcaggaaaattaaatataaatagatttcaaatgaataaatatgggaaaaattcttgaaatgggcagtatgagccttaatagcaattttttactgcacattggagcttgattttttgggtaaaacatctgaaactgaagaaatattttacatgcaaattcttgctttatacacaacaatttgtcacagggtttgaggatatagggataaaagatacagaccctgccctcaagaagatttttgtttagataggaaaaattattatcatccaataataccatgtcacaaatgctgggatagagtcaaagattcttgaaaccagtaaatgtttaaagtgagttttcaagatgaccagggttaatgtggtgaggcagaggaggggtgtttccaagggaagagcagtgtgtgggaaagcacggaagagtgagaaggaaacaactacattttatttactttctatgagtataagtccataggatctttatataaagtttccaattcagttgagaaatatataattttttcagttacatattatttttggtttctattgttttacagggtggcctcacaccacttttgcttgctgtacatggacaaaaacagcgaatggtgaaatttttaatcaagaaaaaagctaatttaaatgcacttgataggtttggaaggtatagttatttcttttaatctctgtgttgttctagattgatagcagtcactcaagtcataaatattaaattaataatactaacttatacttattgggacatagttatcagtagcaacacaaatcagttaagtagaaaaaaacagttatttagactgggcaacataaagaacagttttagtaggactcattttattattttgactgatgttatttgttatgtgatgttattggttgtatgttcttatgttagctaaagggatttcatattagttttagaaagtgtgaactttaactttcagttatgactcagtcttgaacttcttaaccctttctagtagtttttaacctctgcttcttatatggttttccactaaatatgctatattaaacataaataggagttgcaaatcattttgtcttttgaataactctgctttaagttgctttctttaaagaatattaatgttagcttatccctacttgacaatcaattgctattcccacatactgtgggttcatcagatttttccctttttatttccagtgtattttgatgtttttatttttaattagtatggagagagggagcgaagatagtcttaagtggatacacttttcctttcatgaaggcaagccataggtgggtgataaagagaaaagagctaggctttagagtcacacaagactgggtttaattcctagctttcttacttgctaggtgtgtgacattgtgaatgttatttaccaccaaatatgttgtcatgtatgaaaaggaggagaatatatccttcaaagttagctgtgcatagtaagaaagatatatatatatatatatctttatatatatctttttatagcatttaattcagggcctagcacatgcttattggtattcattaactgaaaccactatgaccactattcttaccatttgttattactgctttcagcatgcagatagctcttatttatctgatccctagctgattttctattacagtgtatcagtctagggacctgggaagaaaacttcacttaaatctttgtctacttcagataagcagccctagcatagtttcttgcccatcaaaggcctttaaattagtagctgctactatgcaataccccactgagataagaggtttcctttttgtcccttccttttaaccttgatggtactttataaagatgaacccttgagcacccaagatgcttatgtcttttagtacatgtaaatgtttaattctgcatggacgggcaagatattaaattggcaaagtatattgaattagcttttaaaatcacttgaagttcctaagggagaaattatctctatattattttagaactgccctcatacttgctgtacgttgtggatcagcaagtatagttagtcttctacttcagcaaaatattgatgtattttctcaagatgtatttggacaaactgctgaagattatgcagtttctagtcatcatagtatgtaagtgtttacattaaaagtctagttaaaactacattgaggtttaaaataattataatgattgcatcttatatatcaggtgagatgtgatagattgattcaggtagttttagagtggctatgatttagtccactgcatcagctagaaatgaaacaaaaaactagactagttagaagtaccaatgggtgcaggattctttatctcgggacttttaagacctttatccttagagattccaacattgttcatttcattccatgtataacacctatgcatgggataaaaaatagtgccatatctttaatttttctagttagttatttgggtcttgaaatgttcagtttaggagaaagtcttgtactgtcttctggggactgtctcctatatactccctgaattttttgagaaccaaagggattcactaagtccaaggaagacagtcctttttttcaagtcataaggaggagaaaaaaaggacattttaatcattcttttgtttctgttgattctgttgctgcatcgttgccactgaaactggtcctgctgcctggtaatggttggcctttgacatcaagatgcgcttactgattcaaatccctcaagtcttcatggtgatccatacatggacttcaaagttataaaattttttacattcacatacctatgcctatgtgttcagccattgttcccaaagcaccagcaccctgctctggcagcttagcatcctggctttatccacacacaaagtgagcaaattgacccttccacccacattcaaaacctgatgtggaacccacatgttatcctacacttaactgagactgtcatggtaagagatcctttgagtcccatgttggtcttttctctagcagatattagctgggcttgttctaaactgtcagagaggttcaaataatgtggcagaaagaggtcagtgtttgtttattcttctttgctaccatatctgtaccctgaggcacatttatattgtgtatagtaccttaggcagtagaaagtcccatattaaccttccccagagcagtgagcacccagttatagttgaccccttgaatgatccattttccataataatgagaatctcccaagctacttgcatctcttcctcaagatttaaaaatattttcaaattctacctcactggaagatattgaagagatttctcaggatctcaagtaggttagttggacttagagccaaaccttgtcaatgactcatcactgtccatgtgtaaaagtagagctttgtgcttgcttaggcagcacatatcctaaaattggaacaatacaaagaaaattagcatggtgcctgcataaggaggctgaaccaatttttgaaggattccaagttttgtgcagtcactggaaggtcatttgactattttctgactagctccaaggaaatggtgtgaatcaaagcaaaatgggtgccacctaaatattgaaattgtgattttttgctacaaaaatattcatgtaaggtggtctaagagatgaccccagagctgaataatgtgtggggtgttgtgtgaaaaatatattgccagcatgtgacttgaaaattcaagaaggtcaacttacaacttcttcatggaacctaaaaaaaaaaaaaaaaaagtagggttttagtctcccatgtcagctggagatgagcagggagatgaagcatcatcctaacaaacatctgctggtttagagtttgagtctgtagagaaggatcattggtccaagccaggtgttgacatccagtggattttctgcccttgttgtgattggtaaactccgtaatagtgggcaatcatgttttctactttaatgagatatttatgaataaatttagttacaaactatgaaatagttgagattccttgaattataagccataaagagtaggacaactaataaggaaaattaggacttaacatttcctgaaaattacaacatttgcatattagggcctatgaacaaaatatacattgggttttatttgggattctgagataatttcagtataaagtttaggaatagattatttcattgctttactatttttctgagcatttagaaaatgttatattgttaagtctttgtaacaacctagtgaaataacaacctagtgaaataaggcagcaaagtccccactttgtagaaataacaacctagtgaaataaagcagcaaagtcctcactttgtagaagaagacattgagcctaagagaagtaacttgtccaagaacaagttgagcacttaggcataggtatggatcagctgttcattatggagctaggccttatgcagagttgggacactttctattgtgtcaagctaatgcaagttagtttattgagtcataatgcccttgatttatgagtatttcaccttacttttttcttctttaattagaagcttaatgagaggtttgtagaatgtacacagaactgtatgggataatattgttaagttctgatattctgatactgtttgaaatactcaaagaatttttgcatttggtaagcatttttatatcagtattaaaatagtaattttatttattacatttttatacatagaatttgccaattactttctgactacaaagaaaaccagatgccaaacaactcttctggaaatagcaatccaggtaagacttctgatagtgaattactttaggtcagttgtccccaaccttttcgccttcttggcagcagggaccagttttgtggaagacaatttttgcatggactaggtgaaggtgtggatggtttcagaattattcaagcacattacatttattatgctactttatttatattattattaccttataatatataatgaaataattatacaacttaccataatgtagaatcagtggaaactctgagcttgttttcctgcaactagatgtcccatctgggggcaaagggagacagtgacagatcatcaggcattacattctgataagaagcacacaacctagatccctcacatgggcagttcacaacagggttcatgctccaatgagtatctaatgcaaccactgatctgacaggaggtggagagcaggcagtaatatgagtcatggggtgtggctgtaaatagagatgaagcttccctggcttgcttgcttctcaccttctactctgtggcatggttcctaacaagccatggactggtaccagtccatggcctgggagttgtggatgcttgatctgggtggtcctatcacagataaaaaggtaaaagtaaggaagttttgatcacaaaagaagagcgaagcacaggttatgtttcatatgcttgtaccaacaaagtctcactattactgacttcattcctcctaatttgaaattgaaagagatagatttactttgttggaacaagatgtattcttctacctgctggttaattgtcatgataaacagtaattttgttagaacaagatgctttgctgccagtcgccaaaagattgtcataataaatacacaaattgcccaattctaggctcagcagattataataaaagtacaaaaatgtttcacagtaagaaaaatgctagtatgctacctggatgtggacacctaacgcatcgtacaatccagactctataaggacatctttaatttagccctatgtttatcaaagagcttctgtaagttagattgtgtacattgcaagagacaaagatggaatagatgtagttctgatctttaaggtgctcataatagaatacagctgcctctatttcatttctctgccttttcaacagaatttacaaagaaaatatttttatgttttcacttgtccacttaacaaataactataaaatgtcttttaggtactaagcatttttctaatgctagagaacagaaacaattaaaaatacagacaggagtttgtcattatcattgtcatttttattatgttcctaccttattcagtgcttactgtgtgctagatgcccactggaagtttataattatgatttattgtatattatattgattatgtgccagacatacgtgatgaggaatgaaagctttaaaaaaaagtaggtaggatttaaggtaagcatgcagagtgagtagaatttttctacgtaaagaagtagaagaatgatgtttggcagaaggaacatgtaatgagattgcctgttgggaggaagagcagcaagtgcaaaagacaagatgcttaagcgaactttgtagggtttatgagcagttcacttttgctagtacaactagtgtgagataagagaggttgggaatgaggtgaatatttagctaaggcaagtttatgatagactttttaatactgttgaaatgagtaggtcttattctggggaccacgggaaatttaccttcgatatcttccagtgaggtatttgctttggactgcaaatactagatgagcagtggctaaaacagtaggaaccagagttgttttggttgttcagtgatatactaggttccccttgtccctctttcagctgtgcttcatgtctcctttcatggttggctaatccacaacagttccaaacatcttgttctcacaacacaacatcacaagggctgcttttcttcacacatgtcttttaaatagggagaaaccttagaagcatgcagtggacttcctgtaacatattattggctaggtcacaacatatgcttatccctaaaccaggcactggaagagcaaatgtaagtatgtgattagcttagaataatcatttctctttctgaagctgaggagggggattggaatactgtctcagaagacttgtgtttcttctgcaagaaagaataaggaataagaaagaataagggagccagcaatgtttgctgcagggactcattggagaaatttgagcaggggagtcacaagattaaattagagtattaaggccttttggtaatgttgtaaaacaggggttggcaagctttttctgtaaatgaccaggtggggaatgttttagactatgtggtctctgtcatatctacttaaccctgctgttgtgtgagagcaactatggataatatgtaagcaaataggaatgagtgagctccaataaaatgttattttttttttcacttttggcatttttaataggatttttaggcataacatcttacataaccacacagaaactgtttctggtctttttttattattatactttaagttttagggtacatgtgcacattgtgcaggttagttacatatgtatacatgtgccatgctggtgagctgcacccactaactcgtcatctagtattatgtatatctcccaatgctatcactccccactcctcccaccccacaacagttcccagagtgtgatattccccttcctgtgtccatgtgatctcattgttcaattcccacctatgagtgagaatatgtggtgtttggttttttgttcttgtgatagtttactgagaatgatgatttccaatttcatccatgtccctacaaaggacatgaactcatcattatttatggctgcatagtattccatggtgtatatgtgccacattttcttaatccagtctatcattgttggatatttgggttggttccaagtctttgctattgtgaataatgcctcgataaacatacgtgtgaatgtgtctttatagcagcatgatttatagtcctttgggtacatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcactttttcatgtgttttttggctgcataaatgttttcttctgagaagcgtcttttcatctcctttgcccactttttgatgaggttgtttgtttttttcttgtaaatttgtttgagttcattgtagattctggatattagccctttgtcagatgagtaggttgtgaaaattttctcccattttgtaggttgcctgttcaatctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacctttaagtctttaatccatcttgaattgatttttgtataatgtgtaaggaagggacccagtttcagctttctccatatggctagccagttttcacagcaccatttattaaatagggaatcctttccccattgcttgtttttgtcaggtttgtcaaagatcagatagttgtagatatgcggtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggcgatgtgggctcttttttggttccatatgaactttaaagtagttttttccaattctgtgaagaaagtcattggcagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctggaagaggtccttcacatcccttgtaagttggattcctaggtattttattctctttgaagcaattgtgaatgggagttcactgatgatttggctctctgtttgtctgttgttggtgtataagaatgcttgtggtttttgtacattgattttgcatcctgagactttgctggagttgcttatcagcttaaggagattttgggctgagacgatggggttttctagatatacaatcatgtcgtctgcaaacagggacaatttgatttcctcttttcctaattgaataccctttatttccttctcctgcctaattgccctggccagaacttccaacactatgttgaatagaagtggtgaaagagggcatccctgtcttgtgccagttttcaaagggaatgcttccagtttttgcccattcagtatgatattggctgtgggtttgtcatagatagctcttattattttgaaatacatcccatcaatacctaatttattgagagtttttagcatgaaggttgttgaactttgtcaaaggctttttctgcatctattgagataatgatgtggtttttgtctttggttctgtttatatgctggattacatttattcatttgcgtatattgaaccagccttgcatcccagggatgaagcccacttgatcatggtggataagctttttgatgttctgctggattcgttttgccagtattttattgaggatttttgcatcagtgttcatcaaggatattggtctaaaattctccttttttgttgtgtctctgcccggctttggtatcagaatgatgctggcctcataaaatgagttatggaggattccctctttttctgttgattggaatagtttcagaaggaatggtaccagttcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggaccggtggtgatatcccctttatcattttttattgcatctatttgattcttctctctttttttctttattagtcttgctagcagtctatcaattttgttgatcctttcaaaaaaaccagctcctgggttcattaattttttgaagggttttttgtgtctctatttccttcagttctgctctgattttagttatttcttgccttctgctagtttttgaatgtgtttgctcttgcttttctagttcttttaattgtgatgttagggtgtcaattttcaatctttcctgctttctcttgtgggcatttagtgctataaatttccctctacacactgctttgaatgcatcccggagattctggtatgttgtgtctttgttctcgttggtttcaaagaacatctttatttctgccttcatttagttatgtacccagtagtcattcaggagcaggttgttcagtttccatgtagttgagcggtttagagtgagattcttaatcctgagttctagtttgattgcactgtggtctgagagatagtttgttataatttctgttcttttacatttgctgaggagagctttacttccaagtaggtggtcaattttggaataggtgtggtgtggtgctgaagaaaatgtatattctgttgatttagggtggagagttctgtagatgtctattaggtctgcttggtgcagagctgagttcaattcctgggtatccttgttaactttctgtctcattgatctgtctaatgttgacagtggggtgttaaagtctcccattattaatgtgtgggagtctaagtttctttgtaggtcactcagaacttgctttatgaatctgggtgctcctgtattgggtgcatatatatttaggatagttagctcttcctgttgaattgatccctttaccattatgtaatggccttctttgtctcttttgatctttgttggtttaaagtctgttttatcagagactaggatcacaacccctgcctttttttattttccatttgcttggtagatcttcctccatccttttattttgagcctatgtgtgtctctgcatgtgagatggttttcccgaatacagcacacactcgactctttatccaatttgccagtctgtgtcttttaattggaccatttagtccatttacatttaaagttaatattgttatgtgtgaatttgatcctgtcattatgatgttagctggttattttgctcgttagttcatgcaatttcttcctagtctcgatggtctttacattttggcatgatttttcagcggctggtacccgttgttcctttccatgtttagcacttccttcaggagctcttttagggcaggcctggtggtgacaaaatctctcagcatttgcttgtctgtaaagtattttatttctcctttgcttatgaagcttagtttggctggatatgaaattctgggttgaaaattcttttcttgaagaatgttgaatattggcccccactctcttctggcttgtagagtttctgctgagagatccgctgttagtctgatgggcttccctttgagggtaatccgacctttctctctggctgcccttaacattttttccttcatttcaactttggtgaatctcacaattatgtgtcttggagttgctcttctcgaggagtatctttgtggcattttctgtatttcctgaatctgaaagttggcctgccttgctagatggggaaagttctcctgggtaatatcctgcagagtgttttccaacttggttccattctccccgtcagtttcaggtacaccaatcagacgtagatttggtcttttcacatagtcccatatttcttggaggctttgctcatttctttttattcttttttctctaaacttcccttctcgcttcatttcattcatttcattttccatcattgataccctttcttccagttgatcacatcggcccctgaggcttctgcattcttcacgtagttctcgagccttggttttcagctccatcacctcctttaagcacttctctgtattggttattctaattatacattcttctaaatttttttcgaagttttcaacttctttgcctttggtttgaatgtcctcctgcagctcagagtaatttgatcgtctgaagccttcttctctcagcttgtcaaagtcattctccatccagctttgttccgttgctggtgaggaactgcgttcctttggaggaggagagatgctctgctttttagagtttccagtttttctgttctgtttttttccccatctttgtggttttatctacttttggtctttgatgatggtgacgtacagatgggtttttggtgtggatgtcctttctgtttgttagttttccttctaacagacaggaccctcagctgcaggtctgttggaataccctgccgtgtgagatgtcagtgtgcccctgctggggggtgcctcctagttaggctgctcggggtcaggggtcagggacccacttgaggaggcagtctgcccgttctcagatctccagctacgtgctgggagaaccactgctctcttcaaagctgtcagacagggacatttaagtctgcagaggttactgctgtctttttgtttgtctgtgccctgcccccagaggtggagcctatagaggcaggcaggcctccttgagctgtggtgggctccaccgagttcaagcttcctggctgctttgtttagctaagcaagcctgggcaatggcgggcgcccgttgcccagccttgctgccgccttgcagtttgatctcacactgctgtgctagcaatcagcgagactctgtgggcgtaggaccctctgagccaggtgcgggatataatctcgtggtgcgccgttttttaagcaggtcagaaaagcgcagtattcgggtgggagtgacccgattttccaggtgcgtccgtcacccctttctttgactcagaaaaggaactccctgaccccttgtgcttcccaagtgaggcaatgcctcaccccgctttggctcacacacggtgcacgcacccactgacctgcgcccactgtctggcacttccaagtgagatgaacccagtacctcagatggaaatgcagaaatcacccatcttctgcgttgctcacgctgggtgctgtagaccggagttcaataaaatgttatttagaaaaccataagggagactggatttggcctgtggcctatagttttctgacccctcatagaggattgatggaaggtaaccatgtaaagaaaccaggagacaaaggaagatttgctgtagtcagctacagtttccttgtcacatgtccttggactagtatcaatttattataaggttttcacccatccatcgtgaaataaataaagttaggaatctcagttattcattttaaaatgttggcctttttttggtgttatgcctttttcatttgttttgttttaattttttttcatgtaagaaataacattaacagctgggttttttaaaaaaataaaagccactttgtaaatgtttatgttcccagtggcagtgggaatataaaatggaagcagaagagaggtatagtcaatatgatttagtgactgttgaatgagaaaatttaggggacagagagaaatcccagatgattcacaggtttccaggttgtacagtattatttaacctgaacatgaggaaggagtaggaaattttctggtgaatacagaagagcaaagaagagcagctcaagaggaatgactaattatttttctgtgcatgtttaatgggatattcatataggatttttgaatagatcattgaatatcagcatttatagctggcatcctactagtttgactctcagtaataagacttgtcaaagatccaagaatctgaaagttgatgataaatttccatgtgtatcaccatcaatgactgaaagtcagcatccacagaattgggagagatgaacttaatagataaagatgaattggagttgtgtttctcttagagaatgatactctccatgacttgtgtgagtcacagctgccagaaaacaaagaggccaaggaacatattaaagaagcacagcaaattcagtcctagagtgcctctgcttggcttcgtgttatagttctgacttctaaaaaatcactttttggcaaaatatactttgtgtttcttcccctcttgcaaactgcaaccaaacagaatcctttttagcaaggcatttttgtgttctttgaccaaagcaacatataaataacaaaaagaagtaagagaaagaacttttttttgtgtgtataggctagtatttaacataaacttgagagtgagtgccagtattatatttaggatttagggactagataggaaaactggatagaaatctaaagattgctgactcaaacacaatgtggtttctttgctttattttcacagctctgaattcacaactattagttatatttatatgcactataactttagaaagcaccttcccaaaccaaattttatgtgatttcttataatttagatgactttattatagaattgaatttccaactgttcataagaattattgagcatttgctgcatagtatcatctcagctgtgtccacatgagctacctatcaccttgtgttaatgaataatggttcaccaggaatattggttttggcatttaaagtgatctgtatttaatgcagataggaccagggaccactcttgaacattaatgtccaagcatcttaaaattacacagaatgctttcataatcagaattctgcctcactctccatctttagcccttttccccatgtgccctttctctggcattactgaactgcctgcaatgccctactcactcatccttctcttgtaggcaaatacattcactctttcacaccttactccctctcttgctgcttcctggcatactgccaacctttcctgccctctaccccttgtaatctggctagcctcaatatttaagtctctgcttggccatgatttctagaaaaccatccctgacatgctttattttcattctttttaaatcctaatgcctactatgtatgtagcaggactcagtaaaaaattgctgagtaaaataaagaatgtttatacaaaggtgatatgcaagactgtcccctacagtcttggagccgaggggacagacatgtggagcaataacgtacatttgagatggtaaagatgcagtagaaaaataagtaaagtattaaggcagcctcaaggaaggaggtacctgtttatctggggaaagacatgcagaatcaaggaagacttcacatagcattgttttaaaagatgaaaaaaattgtcagaatagtggagggaaacatttaaatattaggaagacattgtacactaataaaggtgtcagcagtgattttggaaatcatttacaaggcactattaggaagtggagaacagtatactgtgttaccttatatgtttctgccgtattttaatattgtgttcctggtggttttgttcatttacgttgggtggatgaatttgtgagtgaatgtttgacatgtttgtatgtcctcaatctggtggactctggtatctccccaagtggtttgttgaagttttggagaattattacttaagtaactatttcatgaaagattaagcttcatttaagcgctcaatttatgaaatgaaatgtcttaaatctatttttataaaaacaatagttttaaattgttctaagtggttcattttaaccaaatatatggatttcacttcagaacaagacttaaagctgacatcagaggaagagccacaaaggcttaaaggaagtgaaaatagtcagcatgaggcatgtaaaattttaaatttaaatttctggtttaatgttcttttctttgctttgataatagtagatagtccaaatgaaattacctttcagactaggctttgataatcaataaattttttaaaataattttttaatagattcttaaagtttattttaatagatttagtgaccttattaacagaagaatcaatagaatctaatttaatatttgatatttaacttaaagattataacccactataaaatttaaaatattcttatttaaaatattcttatctgccttcttgattggcttatagctaatctttccctttggaatagaggcaaaacaaatccagaactttatttgttcttttatttttacaacatccttacatgataaagaaagtaacatcaattattggatcatattatcaagcaattgaaattatgaacaatgtagcagtgatggtccctgagctggattcatggcaaaggagtaatcatggccagtgattgaaaatctgcggttttatattgccagtcagtgatgccaaggttaaagatgaattctacctgtggtctctcactgacctcagggtttctgttcagggagagaaccaggtcttaaaagcaacccaactgcctattacaataatcatatcttgcagaatgagacctttgttgttagtgtacaaacacagtaacattttaacatttcagttgcagaacatcagtacatattatttaaaaatttttatcctctgtcattagtacacattagaatatattagaactggacttaagccgatagtctagatacataacatgatcgtattatagtacataatttcaattaaaatgtaacaatttgcatttctttctgtttggtgttgattttggctcctaataatttaaagtgtgcctacactccagttagtaatcttttaaaaaaccacctaaatgcactgtaggggctcactacttaaggtatggtgaagtaaaatcttttcaagtgagaaaaaccctacaaattacctgctaattcattttggtagatttaacacataatgaattaagtttaatccaaacaaaaggtgacaaagttaagttttccagttcatgtttttcttctttctttggctaaggtgaatttttttatgttttagtcagaagccagtgatgtggcagtagctaaacatagaataaaatgttaattcttcattttagttatttaattattatttctttaattattttaacaggtaaattttaattttaattattttctaattttttattgtccatacttgattacttaagaataaaattattttaaaaacatgtactccaaaagagcagacatctgagaaacacaacaagcaaattaaccttctataattgcatctgcagaaagtgactcaagaaccagacataaataaggattgcgatagagaggtatacctttatattcaaatgtttccgttgaattagatttttacattatgttgtttaacaaagtataataagtttaggcatgtatgattctatcatgtaagtagcataaatcatcagtgaaaaatttagtatgtaactcagaaagctgagttgtgtacattaagttttaaagagagacaaaccctagaaatattcttcattattatggaataatcctgaatggtgccaaaaatgctacgtaatgctactttaggagctttggatcaatcattttatctttcttggtattagtctgattatcaatagataatatggctaaagaagataatttgttattctgtatatcctctagctagaaagttttatggccactgaatgtgaaatttggggagcgtctcatttactggaattccatgctagcacctcagcagttttattctgctttttgtgttgtgggaaactttggttcccatgtttcagtgagcactttcatgtttttgatatcccagcaaccatatgaaaaagcaatgatcacaggcagtgggggagaagaatattttagtgcaggaaagggaaatcttcctttctattcctggagcccgacagtgtctcatcctctaaatctgactgcttaatggaaaatccaggttgtaaagatggaagaagacacattttgcatctttgtgtttttatttgtgtgttcccacaagtcaaatggggtgaatatttatattagattctgaagagtggttgggaataaaagcacaaaatgaaattttgaaattttggaaattttgaaattttggaaaattgttctattcattcaaagagaaataaagcaaactttacaaaaattttaatgatatactaatgatgtaataattacatcttaaaattatatggtaacagttctgtatatatgatcaaatttaagtgtgaaatatttttaatgacaaattatgacaaactgagtcaaatgataaaatcaattaaaacaaaaaggtactttttattcaataaagcaataactgtccttaatatcaaacttccactcaaggttgaagaagaaatgcagaagcatggaagtaataatgtgggattatcagaaaacctgactgatggtgctgctgctggcaatggtgatggtggattagttccacaaagaaagagcagaaagcatgaaaatcagcaatttcctaacacagagattgaagagtatcacaggtaagcctatggcaacatttaacaggagataactatgtgctatcaaactaatccgaatttggactaatattcatgatgaaaaaattttatacttttcctaggatattcagccttgcctggtaatcagaagaatgaaaatcagcaaacaatgagttatattttttccagtcattaatttatttgaaaaataaccagtgttggcaaatgtgagggaaaaagcattttcttttctttttagtgaacttttattttagcttcaggggtacacgtgcaggtttgttacataggtaaactgtatcatggagattggggttacagattatttcatcagtcagataataagaatgatacccaataggtagttttttggtcctctccctcctgccatgctccaccctcaagtaggccgcagttgtctgttgttctcctctttgtgtccatgagttctcattgtttggttctgacaaatgagtgagaatatgtggcatttgattttctgttcctgcattagtttgcttaggataatgacctccagctccatctgtgttgctgcagaggaaatggactcactgaaaaggatattttcatacactgttggtaaatacattttgagtgttaatttagtagcatattcacacacacacatatataacagtaaggatataaaatatatgtatgttatggatatttgtatagatatattacatatatacttatgtataaggacatttattatagcataattatatcaaaaagttggagctagtccaaatccttatcaataggaaatagctcagaaaataatatagtatgcaatcagttttttaaaatgaagttagatctagagtgtactgattatttcacaattaacatgtatttaaagcatttagtttgctgacccatcttaagacaattttgttagaattcttgtagtatctgctgtgttgcaaatggaagctacatgctatgttgacactgtaccttgttagcaacaatatcgctagttattaaattatggttgtcagtgcctgagtgctgaaataattggaccctcaactgaacattgccaaaggattgcacatggggatctgtattttatgtaaatatttcagtatattggataaaacttgtttaaatacatcaaaggatctttgatctactaaaacaggaattggccagcttttttctgtaaagagccagttggtaaatattttaatctttgtggactatatgtacttatttttttgagacaggttctcactctgttgcccaggctggagtgcatttgcgtgatcatggctcactgcagcctcaactttctgggctctagtgatcctcccacctcagtctctctactagctgggaccacaggtgtgcaatatcacacccagatgattgactctatggactataaagtaaataagcatggctgtgtttcaagataccttacttaaaaaaacaggcagtgggctggagtgggcccacaagtgttaatttgctgacccttgtgctaaaaggaaggtgttgctaatgcagtgaatcttatttgtaagtgtcctgcatgcatgacattatccttcctttgaaaaaagaatatatttcagtattcacctcaccatagttttcaagtgacttcatataatttttatattgatgtaattcatgtaattatacttcataaaatttttaaaatttcatttataaaataagattattttctgcatttctcctattttattcctgttaataggactcagtattttactgtgatcaattactttgtatatgtgatgagtatcaactgtcctagatttcactgatttttatcaagcaagaaatactcctcttgaaacttttagtattccttggtctttatttttattcatttatttttattttattttattattattatactttaagttttagggtacatgtgcacaatgtgcaggttagttacatatgtatacatgtgccatgctggtgtgctgcacacattaactcatcatttagcattaggtatatctcctaatgctatccctctcccttccccccaccccacaacagtccccagagtgtgatgttccccttcctgtgtccatgtgttctcattgttcaattcccacctatgagtgagaatatgcagtgtttggctttttgttcttgcgatagtttactgagaatgatgatttccaatttcatccatgtccctacaaaggacatgaaatcatccttttttatggctgcatagtattccatggtgtatatgtgccacattttcttaatccagtccatcattgttggacatttgggttggtttcaagtctttgctattgtgaatagtgccgcaataaacatacgtgtgcatgtgtctttatagcagcatgatttataatcctttgtgtatatacccagtaatgggatggctgggtcaaatggtatttctagttctagatccctgaggaatcaccatactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgaacattttttcatgttttttggctgcataaatgtcttcttttgagaagtgtctgttcatgtcttttgcccactttttgatggggctgtttgtttttttcttgtaaatttgtttgagttcattgtagattgtggatattagccctttgtcagatgagtaggttgtgaaaattttctcccattttgtaggttgcctgttcactctgatggtagtttcttttgctgtgcaggagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatgtggctagccagttttcccagcaccatttattaaatagggaatcctttccctatttcttttttttgtcaggtttgtcaaagatcagacagttgtaggtatgcagcattatttctgagggctctgttctgttccattgatctatatctctgttttggtaccagtagcaggcttaggattgacttggcgatgcgggctcttttttggttccatatgaactttaaagtagttttttccaattctgtgaagaaagtcattggtagcttgatggggatggcattgaatctaaaaattaccttgggctgtatggccatttttatgatattgattcttcctacccatgagcatggaatgttcttccatttctttgtatcctcttctatttcattgagcagtggtttgtagctctcctcgaagagttcctttacgtcccttgtaagttggattcctaggtattttattctctttgaagcaattgtgaatgggagttcactcatgatttggctctctgtttgtctgttattggtgtatgagaatgcttgtgatttttgtacattgattttgtatcctgagactttgctgaagttgcttatcagcttaaggagattttgggctgagacaatggggttttctagatatacaaacatgtcatctgcaaacagggacaatttgacttcctcttttcctaattgagtaccctttatttccttctccggcctaattgccctggccagaacttccaacactatgttgaataggagtggtgagagagggcatccctgtctcgtgccagttttcagagggaatgcttccagtttttgcccattcatatgatatttgctgtgggtttttcatagatagctcttattattttgagatacatcctatcaatacctaatttattgggagtttttggcatgaagggttgttgaattttgtcaaaggccttttctgcatctattgagataatgatgtggtttttgtctttggttctgtttatatgctggattacatttattgatttgcgtgtattgaaccagccttgcatcccagggatgaagcccacttgagcatgttggataagctttttgatatgctgctggattcggtttgccagtattttgttgaggatttttgcatcaatgctcatcaaggatattggtctaaaattctctttttttgttgtgtctctgcccggctttggtatcaggatgatgctggcctcataaaatgagttatggaggattccctctttttctattgattggaataatttcagaaggaatggtaccagttcctccttgtacctctggtagaattcggctgtgaatccatctggtcctggacttttttttgttggtaagctgttgattagtgccacaaattcagagactgttattggtctattcagagattcaacttcttcctggtttagtgttgggaaggtatatgtgtcaaggaatttatccatttttctagattttctagtttatttgcgtagaggtgtttgtagtattctctgatggtagtttgtatttctgggggatcagtggtgatatcccctttatcattttttattgcatctatttgattcttctctcttttcttctttaatagtcttgttagcggtctatcaattttgttgatcctttcaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttaggttgtcaattttggatctttcctgctttctcttgtggaaattttgtgctataaatttccctctacacactgctttgaatgcgtcccagagattctggtatgttgtgtctttgttctcgttggtttcaaagaacatctttatttctgccttcatttctttatgtacccagtagtcattcagaagcaggttgttcagtttccatgtacttgagcggttttgagtgagtttcttaatcctgagttctggtttgattgcactgtggtctgacagacagtttgttataatttctgatcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttaactttctgtctcattgatctgtctaatattgacagtggggtgttaaagtctcccattattattgtgtgggagtctatgtctctttgtaggtcactcaggacttgctttatgaatctgggtgctcctgtattgggtgcatatatatttaggatagttagctcttcctgttgaattgatccctttaccattaagtaatggccttctttgtctcttttgatctttgttggtttaaagtctgttttatctgagactaggattgcaacccctgcttttttttgtttttcatttgcttggtagatcttcctccatccctttattttgagcttatgtgtgtctctgcacatgagatggttttcccgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtgtagtgcttccttcaggagctcctttagggcaggcctggtggtgacaaaatctctcagcatttgcttgtctgtaaagtattttatttctcctttgcttatgaagcttattttggctggatatgaaattctgggttgaaaattcttttcttcaagaatgttgaatattggcccccactctcttctggcttgtagagtttctgctgagtctcatgggcttccctttgagggtaacccgacctttctctctggctgcccttaacatttttttcttcatttcaactttggtgaatctgacaattatgtgtcttggagttgctcttctcgaggagtatctttgtggcgttttctgtatttcctgaatgtgaatgttggcctgccttgctagatgggggaagttctcctgcataatatcctgcagagtgttttccaacttggttccattctccccgtcactttcaggtacaccaatcagacatagatttggtcttttcacatagtcccatatttcttggaggctttgttcatttctttttattcttttttctctaaacttcccttctcacttcatttcattcatttcattttccatcattgataccctttcttccagttgactgcatcggctcctgaggcttctgcattcttcaggtagttctcgagtcttggctttcagctccatcagctcctttaagtacttctctggattgattattctagttatccattcatgtaaatttttttcagagttttcaacttctttgcctttggtttgaatttcctcccatagcttggagtagtttgatcatctgaagacttcttctctcaactcgtcaaagtcattctccatccagctttgttccattgctgttaaggaactgtgttcctttagaggaggagaggtgttctgctttttagagtttccagtttttctgctctgttttttccccatgtttgtggttttatctccttttggtctttgatgatggtgatgtacagatgggtttttggtgtggatgtcctctctgtttgttagttttccttctaacagacaggaccctcagctgcaggtctgttggagtttgctagaggtccactccagaccctatttgtttgtgtatcagcagcggtggctgcagaacagcagatttttgtgaactgcgaatgctgctgtctgatagttcctctggaagttttgtctcagaggagtacccggccgtgtgaggtgtcagtctgcccctactggggggtgcctcccagttaggctgctcaggggtcggggtcagggacccacttgaggaggcagtctgcccgttgtcaaatctccagctgcatgctgggaggaccaatgctctcttcaaagctgtcagacaggtacatttaagtctgcagaggttactgctgtctttttgtttgtctgttccctgcccccagaggtggagcctacagaggcaggcaggcctccttgagctgtggtgggctccacgcagttcgagcttcctggctgctttgtttatgtaagcaagcctgggcaatggtgggtgcccttcccccagcctcactgccaccttgcagtttgatctcagactgctgtgctagcaatcagcgagactctgtgggtgtaggaccctccgagccaggtgggggagataatctcctggagcaccgttttttaagccccttggaaaagcgcagtattcgggtgggagtgacccgattttcttggtgtcgtctgtcacccctttctttgactaggaaaaggaactccttgaccccttttgcttcccaagtgaggcaatgcctcaccctgcttcggctcacacatgttgtgctgcacccactgtcctgcgcccagtgtctggcactctctagttagatgaacctggtaccgcagatggaaatgcagaaatcacccgtcttctgtgtcactcatgctgggagctgtagaccggcgctgttcctacttggccatcttggcctgggacccccttggtctttatttataagcatgaacaaaatgataatcagcttatataatccagaaatgttcacggggtcttttagttgtataatttttttattattatactttaagttctagggtacatgttcacaacatgcaggtttgttacatgggttatacatgtgccatgttggtttgctgcccacattaactcatcatttacattaggcatttctcctaaggctatccctccccctgggccccacactctgacaggccccagggtgtgatgttccccatggtgtgtccaaatgttctcattgttcaattcccacctgtgagtgagaacgtgcggtgtttggttttttgtccttgtgatagtttactgagaatgatggtttccagcttcatccatgtccctgcaaaggacatgaactcatcctttttcatggttgcatagtattccatggtgtacatgtgccacattttcttaattcagtctatcattgatggatatttggattggttccaagtctctgctattgtgagtagtgccccaataaacatatgtgtgcatgtgtctttatagcagcatgatttataatcctttggatatatacccagtaatgggatgactgagtcaaatggtatttctagttttagatccttgaggaatcaccacactgtcttcgacgtggttgaactagtttacactcccatccacagtataaaagtgttcctatttctccacatcctctccagcacctgttgttccctgacttttaaatgatcaccattctaactggtgtgagatggtatctcattgtggttttaatttgcatttctctgatgaccagtgatagcattttttcatgtgtctgttggctgcataaatgtcttcttttgagaagtgtctgttcatatccttcagccaattgttgatgtgattgttagtttttttcttgtaaatttgtttgagttctttgtagattcttgatattagccttttgtcagatgggtagattgcaaaaattttctcccattctgtaggttgcctgttcactctgatggtagtttcttttactgtgcagaagctcttcagtttaactagatcccatttttcaattttggcttttgttgccattgcttttggtgttttagtcatgaagttgttgcctatgcctacatcctgagtagtattgcctaggttttcttctacgatttttatagttttaggtctaacatttaagtctttaatcaattttgaattaatttttgtataaagtctaaggaagggatccagtttcagctttctacataagctagccagttttctcagcaccatttattaaatagggaatcctttccccgtttcttgtgtttttttttttttttttgagagggagtctcgatctatcacccaggctggagtgcagtggcgtgatctcggctcactgcaacctctgcctcctgggttcacatgactctcctgccttagcctcccaagtagctgggactacaggcgcttgccactacgcccggctaattttttgtattttttagtagagatggggtttcaccatgttagccaggatggtctcaatctcctgacctcgtgatctgcgcaacttggcctccgaaagtgctgggattacagacaagagccaccacacctggccccccatttcttgtttttgccaggtttgtcaaagatcagatagttgtagatgtgtggtattatttatgagggctctgttctgttccattggtctgtatctttgtttggtaccagtaccatgctgttttggttactgtagccttgtagtatagtttgaagttaggtagcatgatgcttccagctttgttcttttggctgaggattgacttggcaatgcaggctcttttttggttccatatgaactttaaagtagtttttccagttctgtgaagaaaatcattggtagcttggtggggatggcattgaatctataaattaccttgggcagtatggccattttcacgatattgattcttcctatccatgagcatggaatgttcttccatttgtttgtatcctcttttatttcattgagcagtggtttgtagttctcctcgaagagttcctttacgtcccttgtaagttggattcctaggtattttattctctttgaagcaattgtgaatgggagttcactcatgatttggttctccgtttgcctgttattggtgtataagaatgcttgtgatttttgcgcattgattttgtatcctgagactttgctgaagttgcttatcagcttaaggagattttgggctgagacgatggggttttctagacatacagtcatgtcatcttcaaacagggacaatttgactttctcttttcctaattgaatgccttttatttccttctcctgcctgattgccctggccagaacttccaacactacgttgaataggagtggtgagagagggcatccctgtcttgtgccagttttcaaagggaatgcttccagtttttgcccattcagtatgatattggctgtggatttgtcataaatagctcttattattttgaaatacatcctatcaatacctaatttattgagagtttttagcatgaagggctgttgaatgttgtcgaaggccctttctgcatctattgagttaatcatgtggtttttgtctttggttctgtttatatgctggattacatttattgatttgcatatgttgagccagccttgcatcccagggatgaagcccacttgagcatggtggataagctttttgatgtgttgctgcattcggtttgccagtattttattgaggattttgcatcgatgttcatcaaggatattggtctaaaattctctgtttttgttgtgtctgtggcaggctttggtatcaggatgatgctgacctcataaaatgagttagggaggattccctctttttctattgtttggaatagtttcagaaggaatggtgccagctccttcttgtacctctagtagaatttggctgtgaatctatctggtctttgactttttttggtttgaaagctattaattattgcctcaatttcagagcctattattggtctattcagagattcaacttcttcctggtttagacttgggagggtatatgtgtccaggaatttatcaatttcttctagattttctagtttacttgcatagagatgtttataatattctctgatggtagtttgtatttctgtgggatcggtggtgatatcccctttatcattttttattgcatctatttgattcttctctcttttcttctgtattattcttgcttgcagtctatcaattttgttgatcttttcaaaaaaccagctcctggattctttgattttttgaagggctttttatgtttctatctccttcagttctgctctgaccttagctatttcttgccttctgttagcttttgaatttgtttgctcttgcctctctagatcttttaattgtagtgttagggtgtcagttttagatctttcctgctttctcttgtgggtacttagtgctataaatttccctctatacactgctttaaatgtgtcccagatattttggtacatcatgtctttgttctcattggtttcaaagaatatctttatttcagccttcatttcattatttatccagtagttatttgggagcaggttgttcagtttccatgtagttaagtggttttgagtgagtttctttatcccgagtcctaatttgattgcactgtggtctgagagaccgtttgttgtgatttctgttcttttacatttgctgaggagtgctttacttacaactatgtggtcaattttggaaaaagtgcaatgtggtgctgagaatgtatattctgttgagttggggtggagagttctgtagatgtctattaggtctgcttggtgcagagctgagttcaagtcctagatatcctttttaaacttctgtcttgttgagctttctaatattgacagtggggtgttaaattctcccattattattgtgtgggattctaagtctctttgtaggcctttgaggacttggtttatgaatctgggtgctcctgtattgggtgtatatatatttaggatagttagctcttcttgttgaattgatccctttaccattaggtaatggccttctttgtctcttttgagctttgttgatttaaagtctgttttatcagagagtagaattgcaacctctgcttttttttcctttccatttgcttggtagatcttcctccatccctttattttgagcctatgtgtgtctctgaatgtgagatgggtctcctgaatagagcacactgatgggtcttgaatctttatccaatttgccagtctgtgtcttttaattggagcatttagcccattacatttaagattggtattgttttgtgtgaatttgattctgtcattatgatgttagctggttattttgcccgttagttgatgcagtttcttcctggcatctatgatctttacaatttggcatgtttttgcagtggctggtactggttgttactttccatgtttagtgcttcattcaggagctcttgtaaggcaggcctggtggtgacaaaatctctcagcatttgcttgcctgtaaagtgttttatttctccttcacttatgaagcttagtttggctggatatgaaattctgggttgaaaatttttttctttaagaatgttgataccttacatctacaaccatctgatctttgacaagcctggtaaaaacaagaaatggggaaaggattccctgtttaataagtggtgctggaaaaactggctatccatatgtagaaagctgaaactggatcccttctttacaccttatactaaaattacttcaagatggattaaagacttacatgttaaatctgaaactttaaaaaccccagaagaaaacctaggcaataccattcaggacataggcatggataaggacttcatgtttaaacaccaaaggcaatggcaacaaaaaccaaaattgacaaatgggatctaattaaactaaagagcttctgcacagcaaaagaaactaccatgagacttaacaggcaacctacagaatgggagaaaatttttgcaatccactcttttgacaaagggctaatattcagaatctacaaagaactcaaacaaatttacaagaaaaaaacaaccccatcaacaaatgggcaaaggatatgaacagacacttctcaaaagaagacatttatgcagcccacaaactcatgaaaaaatgctcatcatcactggccatcagagaaatgcaaatcaaaagcataatgtgataccacctcacaccagttagaatggtgatcattaaaaagtcaggaaacaacaggtgctggagaggatgtggagaaataggaacacttttacactgttgggagtgtaaactagttcaaccattgtgaaagacagtgtggcaattcctcaagggtctagaactagaaataccattggacccagccatcccattactgggtatatacccaaaggattataaatcatgctgctataaagacacatgcacacgtatgtttattgtagctctattcagaatagcaaagacttggaaccaacccaaatgtccatcaatgatagactggattaagaaaatgtggcacatatgcgccatggaatactatgcaaccattaaaaatgatgagttgatgtcctttgtagggacatggatgaagctggaaaccctcattctcagcaaactatcgcaaggacaaaaaaacagacaccgcatgttctcactcataggtgggaattgaacaatgagaacagttggacacaggaaggggaacatcatacactggggcgttttgtggagtggggggaggggggatagcattaggagatatacttaatgtaagtgatgagttaatgtgtgcagcacaccaacatggcacatgtatacatacataacaaacgtgcacgttgtgcacatgtgccctagaacttaaaaaaaatgttgaatattggcccccactctcttctggcttgtagagtctcccaagagatctgctgttagtctgatgggcttccctttgtgggtaacctgacctttctctctggttgcccttaacattttttccttcattttaaccttggtgaatttcacaattatgtgtcttggggttgctcttcttgaggagtagctttgtggtgttctctgtatttcccaaattttaatgttggcctgccttgctaggttggggaagttcccctggataatgtcctgaagagtattttcctagttggttccatccttccttgtcactttcaggtacaccaatcaaacgtagatttgttcttttcacatagtcccatatttcttggaggctttgttcatttctttttactcttttttctctaaacttgtcttcgttctttatttcattaatttgatcttcaatcactgataccctttcttccactttagcaaatcagctattgaagcttgtgctttcatcatgtagttctcatgccatggttttcagctccatcaggtcatttaaggtcttttctacattgtttattctagttagccattcatctaatcttttttcaaggttccttgcaatgggttcgaacatcttcttttagcttggaggtttgttattaccgaccttctgaagcctacttctgtcagctcatcaaagtcattctccagccagctttgttccgttgctggtgaagagctgcgatcctttggagggaagaggggctctggtttttagaattttcagattttctgctctggtttctccccatctttgtagttttatatacctttggcctttgatgtcggtggccagaaatggggttttggtgtggatgtccttttagttgatgttgatgttattcctttctgtttgttagttttccttctaacagtcaggtccctcagctgcaggtctgttggagtttgctggaggtccactccagagcttgtttgcctgcatatcaccagtggaggctcagttggaaatgcagaaatcacccatcttctgtgtcaatcatgctgggagctgcagatgggagctcttcctatttggccatcttggaacgtaatattttagttctataattttaagaatataataccttggtctggcatgtttaaatgccattttgtataatttttataacctttaaaatatacaattgttacttaaaatttgaaaactgcaccatttatataaaattataaactactatttcttatctatcactagtccatgactgtggaagaaaattacatcattcactgtcatgactcctaaatatgatgtccttaaaagaactgtctgcactcacaaactgaaattttctttccattcattcttgatcttatttcagtagtcttcaatttcagcactcctccaaagttgtttttctcaagattatcacaacttttattgtgtaataaatctaggcattttttcttacatctcattttatttaatttatcagcagtatttgacccagtggaggatatctccttcataacagcatcttcacttggttttcaagacctcactccctcaggctttttctcctgccttcgtagtccattcatcatggtctgtttttgttgctcctcctcatctttcaccttttgcacattgttgtttcccagggctcagtccctaatcttctttctcatgacttttttttttttttgaggtggagtctcactctgtcacccatgctagagtgcagtggtgaaacctcagctcattgcaacctgtcttgtgggttcaagcaattctgctgcttaaacctcctgagtagctggaattacaggcacctgccaccatgcctggctaatttttgtctttttagtagcagcatggtttctccatgttggccaggctgttctcaaactccggatctcagatgatctgcccacctcagcctcccaaagtgctgggattaaggtatgagccagcaccccagcccctcatgactttttctaatgtgtatatgctagtgatttccaaatgtatgtctctagctcagacctctcaccttaattccagatctctatatcaacctgcctacttgacatctctttttggttggctattgggcatcacacacttgccagatccaaaattgggctactggtgcccttcctgaaatcgacacctcatgcaatctttcctaatttggttagtggccactcttccagttgctctaccaaaaaccttggtgtcattcttgactcatctttctttctctcttatacctcacatccaatctatcagtaaatcttgtcaggtctactggaagaatatatccagaagccagtcatatcttttatatctgagccaccatcatctgtagtctagatgagtgtcatagactggtaatggatagtcctggtttttaaaaaatttcctttaaatctattcttaactcagtggcaaaacataagtcgaattgtgtcattcctctgccccaacccttctgattgccttccatttcactctgagtatgtgacaaaattcctcctaataactaaaaggcagtacaccatctagcatgttttctctcctgcttaaacttctattacttctctcctttgctctgcttcagccacactgaacttctcgctattccttatctatctctcttgctgaacgactccaggtacacctctatacttggcagttccttgtgttcttcagttctttacttaaaaatcccctttctcagcagggacctttctggccatcccaacttttccaccacccttcccctcaaacacataatcatttcattttcctgctttagtttttctcctctaacatactgtatattttgccttatctgtctattgttgtgtgtttatctcattctcatgaataggatttttattgttcactaccatatcctcagtgcctagaaaaaggcctagcatatcggatgtatctacctaacaaatactcgtgggtatattacatttgattgattctcacttaaaaaatgtttgacaaggttcactctaacaacttagcctggtaattatatgcataaattcttttggctctttataataagctacattcttaatattttttcatttagggagaaaatcccaatattgtggttattcaccatttattattttactggtaatcatgataattttaattatggtaaaatgcatcagaggaattgcaaactttactggtattttatctgaaaaatattagggtggtaaatttaatggacttacaaattctttccaacggattatgaaacttcagtatttgaaataaaaaaacagagttggaattttttgcttgctgtataagaggtgtactgatcaggcactgtctgctctgatggagcagctgctgctgcttggctgtctttcagaagcaagctgctcacattgatattggtgggcaagcaagggcagcggtcattgatcgattgactagatttagaacttgccctgggtggcttcttgttatcatggctacaggtcagttcttttctaagtttgtgctgtttaaaggttgccttccattaactattttcaaaatgaaactattttatattccagaattgcatacttaattttaaagttttttcaagatgaattggttaataatagctctcaggaagacctttttttttttttttttttgctacatagtcttgtcttaaccagaagagttctctgtataatttatttcttaaaaataatggttttgtttttgttttcagtgtttttagaagcttttgctcaagtcctaacataaactccaatgggagattttaatctctttgtcagttcatggatgtgtatgatagtgatattctctctttttaaattccttttcttgttcactttcttctttgtacaataatagtgatattcttgtgcatgtttacctcattaaaaagtaattacaattttctgctggcaaatccagctttttatattttgactaaataggaggctaaaagtgaagaacatttaccagattgttttattttcaaacaaaatcataactaatcaaaaattgctatttttgaaatataaataatgacatttagatattttaaaagtaaggatagcccccgatgtaggttggctttgtgtccccacccaaatctcatgtcaaattgtgattcccaggtgttgtgagaaagacctggtgggaggtgattagatcatagggttggtttcccccatgctgttctcatgatagtgaatgagttttcacaagagctgatggtttcttaaagggctctatccccttcacttctctctctcctgccaccttatgaagaaggtgtctgcttccccttcaccttaccatgattgtaagttttctgaggcctccccagccatgtgtaactgtgaatcaattaagcttctttcctttatgaattaccccatctcagatatttctttgtagcagtgtgaaaatggactaatacagagaattggtaccagggatagtggggtattgttaaaaagataatgtgaaaaggtggaagtgactttggaactgagtaacagaggttttaacagtttggagggctcaaaagaagacaggaagatgtgggaaagtttggaacttcctacagacttgttgaatagttttttttaccaaaatgctgatagtgatatggccaatgaagtccaggctgaggtgatcttaggtggagataaggaacttgttggggactggaacaaaggtgactcttgatatgctttagcaaagagactgacagcattttgcccctgcactagcaatctgtaaaactttgaacttgagagagatgatttaggctatctggtagaagaaatttctaagcagcaaggcattcaagaggtgacctggttgattctgaaagcattcagttttatgcattcacaaagagatggttttaagctggggcttatgtttaaaagggaagcagagcataaatttggaaaatttgtagcctgaccatttggtagaaaagagaaacaacacattttctatggacgaatgcaagttggctgcagaaatttgcataaataacgaggagcggaatgttaattgccatgaaatggagaaagtgtctttagggcatgacagagatcttcgtggcagccactcgcatcacaggcccagagtcctggaaggaaaaaatggtttcataggtttgggtccagggccctggtactgtgtgcagcctcaggacttgctgccctgcattcagccactacaggtccaactgtggctaaaagggaccaaggagaaacttagcctttatgaattacccagtcttcagtatttctttatagcagtgtgaaaatggactaatacaccctccctgaagacattttcctgatttcgtctttcatgttttatgtgccacagctacttttgaaattgtatttaaaggtaaacattattatattgaataatagaaacagaaatatagcccaaatctaattgtgattttcatgtttaacagtcatttctcatattcagtggactccagctttttaatatagcattcaagtgtagtgtagattcatctcctattcttagcttccaagtattttacacttttcctttcaagttcttagtaagcatctagacttcatgtgcttaatctttgtgctcacattctgttctctaactggaaggattttctctcactgtttttccctagtgggcccttcttatattttgcctcttctctaaagccttccttgtgctaaaatataactttttaatatatcaactcttacagaacacaatgtattataattgtatattaccttgtttttgaagcaggggatgcacatttccttttatgttgtttgtagttctaaacatttaaaaaattaatcagtgcaatgagatggaaaacagttggagttttacaaaaattgtggtttttttgttcattgtcaatagagttattaggaaacattggctttttatagagtttttaaagtagagcttttgccttgcatatgaagaaagaaacatgaaaataaaaaacggacctcaaaataatctgtgattacacccatatttgagaaggccaatttactaactcatggtctgcaacaagtaaatgatgatagcagtttaagtgaaatagatggtaaagaaggtaaaatttataagtcctttataagaaatatctgggaacaccccctcaaaaagtgggcaaaggatatgtgcagacacatctcaaaagaggacatttacgtggccaagaaacatgaagaaaagctcatcatcactgatcattagaaaaatgcacatcaaagccacaatgaggtaccatctcatgccagttagaatggtgatcattaaaaagtcaggaaacaacagatgctggtgagcctgtggagaaacaggaacacttttacactgttggtgggagtgtaaattggttcaaccattgtggaagacagtgtggtgattcctcaaggatctagaaccagaaataccatttgacccagcaatcccattagtgggtatatacccaaaggattataaatcatgctactataaagacacatgcacacgtaagtttattgcggtattatttacaatagcaaagacttgtaaccaacccaaatatccatcaatgatagactggataaaaaaagtgacaaatataatccatggaatactgttcagccataaaaaagaatgagttcatgtcctttgcagggacatggatgaagtgagaaactatcattctcagcaaactaacatgggaacagaaaaccaaacactgcatattctcactcacaagtgggagttggacaataagagcacatggacatagggaggggaacatcacacactggggcctgcctgggggtgagggagcaaggggagggagagcattaggacaaatacctagtgcatgcaggacttaaaacctagatgacaggttgataggtgaagcaaatgaccatggcacatgtatacctttgtaacaaacctgcacgttctgcacatgtatcccagaacttaaggttaaaaaaattttaaagtcaaaaaaaaaaaaaaaaagaaagaacaaaaaagaaagaaaagaaaataaatctctaggaaagaacgttaacaccaattacttttcctggaactagaataatatagtctcctcaaactggaaatactcaactgtatcagtgctgttgaaagattgattataataaggattagtgactttgactaggagaagtttcaacaaatgatagccatggaaatctgtagtggatgaatgtagacaactcttgagagaaaatttgctgggaaaggcaatatagaaatgggcaataattaaaaaagagtgtgggatttgagggagttttctctctttgtgtttcaaaacagaaatttttagagtttattttttactgttgggaatgatccataagagaagaacatggttatgaaaggtaattttgtttgcttggttgcatgtctaagcattagacagcttgattcattatcttttatggatttttagcaaactaattgcccttagaacttctattcatgtatagttttatgattagagttgttttttcagaattggttcagaagtgtaacatgttagtgtaactgtacatgccgatgatgacctaaaacttaaactgtcatacacagatttttaaaaagaattataataaacattcacacacttaggccatgctgaatagaatttaaatgttccttcataattgcacatcttgcactacctttgacagtagcatcatgaatagccatgatttgcttaggtacttactctaaaatatcaggtgtatcaactttatgattgtttagattctggggagtagggaaggattttgttcatgaagttgagaaaagcaaactattgacaatctattgcagattattacttcaggattataaactcctaaagcatcaaagccatattttcctgggccagcaatgttatcagcatatattgtatgctcaatgagtatttgttgaatgcatgaataaacagttgaagaaataaatgaatgacattgataaatttcttttaaaaactaatttttagttttttgaaagtagtaggtttccaaacttgcctctgtataaagtctttattttttaaaaaagtgcaggattcatgttctcactcataggtgggaattgaacaatgagaacacatggacacaggaaggggaatatcacataccagggactgttgtggggtggggggaggggggagggatagcattaggagatatacctaatgctaaatgatgagttaatgggtgcagcacaccaacatggcacatgtatacatatgtaacaaacctgcacgttatgcacatgtaccctaaacttaaagtatgtatatataaaaaaaagacactgcaattttcaaaaggtgaaaaaaaagtgcaggattcagaaattattagttatagccaaaaacagaatgataatcagaaatttttagttatagccaaaaacagaatgataatatggatttgtctgctatcatatctcttaaaaacacttgaatataaatattaccttcacagcatattgcaaaacacatgttttggagggagaattcttggatttcaatgctgtgtcaattactgaccagctctatgggctgggaaaatttatatggcctttctgggcctagtttctttctttatagaagccctaatattacctacctcaaagaattgttatgatgattaaaatgagcttgacacatgcacagtgcttagaatgatgcatagtgtctgcataataagtcctgaaaaagctaatattatcatttaaaaaagggttcccctcacataagaacataaataatgttttccaaataggtttcagtgccagtaaaagcttgtttttattgaaaaggacagcaatgagaagtcctggtatatgtctttctatcacataatatcagtaacatgtttttccttttgccttgactgtcagaaagcttgatctaaattcaattctttgtaatgatattattattatcatattttctttctcccttaatgttactctttctgtttatagtttaattccccatgtggaaaatagttatatttacattacctgttaaaaaatgacctgaacacttaatggatagaataaataacttataaatgccgagattttatataataaaataatagatttggacattatttgtattttatgtatttgtttgtctaagaagaattgtttcttttttcaggcctgaaaagaaatctaatgaaaagaacaaggtattgtaataagtaaattatctgaaacattattgttaaaaaaacacattataaaaggtaaagtgagaaccttttttaataaagacaattagttagaataaaagggcttaataacaagtacccattgataacggtacccttttaagaaaaatctgttgttttaagaagcacctgtggttttgctcatataaaaatatgaataaataccacttctgtacaactggtatattctatgaatattttgaggacatttgaggcagtattatttatcttacaggtcaaaagccaaatacattcagtggataaccttgatgacataacatggccatcagaaatagcgtcagaggattatgatttgcttttctctaattatgagacttttacattgctcattgaacaactcaaaatggattttaacggtaggaccattgcataagtagaaggccttttaatgtatcccacagtaatattcacacacattgcttagtattgcaccacagagcactgacgtgtgatagggatgatcatctcagaaacgtgtttgacattaaaatagactgagaaataatgtatattgtataccaaagagctatgataactccactgtacctttctcagtgtgaagggcagtctcagcctttttattgactctgcttctcccagatcgggttaccattctctcccactcagaatactgcagtaaccttagaactatttttcctgctaccccacttcctgagaccatggtctactctgaaactataattattaatttaaaaaaattcagatctgatgttgtctcttccttgtaactcagcataccacttgccattgctattaggttaagatctgaatattctagctctctcttgcatcatttaatacccttttttccctgccctagccattgtcttagatgtttattcctgcaatttatagctttagtgaggtataactgatatatgataggctgaatgtacgtaaaatatacgatttgataagttttggcatacgtatgcacatgtgaaaccatcaccataatcaagagcagtaacatgcccatcatccataaaaatctcttcctgtccgtttgtattctccttattaagaaactactaaatgtttaagtatttatactgtattccattcccatcagcagtatatgacaattctcattgtgcaatgtcatcatgagctcttagtattgctgtttattagtttttactgttagccattccaatgggtgcatattgtgcgtgtcactgtggtgtgaatatgcattgacctaaggactaagaatgttgaacatcttcccgtgtgctgatttgccacctgtatatcttctttagtgaactgtcttttccaatctggatagcttataaagatttaaaaattagatagtttttattcttatttgctgagttttaagagttttttaaaataaattctggatatcattccattattatgctttttcagaaagattttttcccagtttgtagcttgactttttgttttcttaataatatattttaaagagctgaagtttttcgttttgatgaaatgtgatatatctgttcgtttaattacagactttgctttttgtctcatgcctaaaaaaagtctttgtccagcacagggtcccagagatttttctcctctgctttcttgaagaatttttatagttttaggttttatatttagatctgtgatccacattgtgtacatttttgcatatgagtgaggtgtgatgtaagttcattgtatggatgtggatatctatctgttccagcagcatatgttgaaaatgctgtcttttctccatacattgctattgtccctttgtgaaaagtaagctggcatatgtgtgtgtgtctatttctggaccatttgttgtattccatcaatctgcgtattcttctagagttatactgatgaaccaatcataatttgaaaatcaatttaataccccaataaacccattgtacagttgaaaaattctaagtagaaccatcttaaactggagactatctctatctggctttcttcatgtaggtctagcatccctaatccaaaatccaaaatcagaaatgctgcaaaatccaaaactttttgagtgccaaaatgatgccacaagtagaaaatttcaaactagacatcaggtacacaaactttcatctgcaaatttactaaaagtgttccataaaattacctttaagccctgcatataaggtgcatgtaacataagtgtattttgtgtttagagttcgattccatttttgagatatctcattatatatgtgcaaatattccaaaacccaaaacacttttggtaccatgcacttgtagagatattccacccatatcacactgtttcattactgtaaatttatactaaatcttgacaccagcccttcagttttcttcttttttaagggttattttgattatgttggatcttttgcatttgcacttgagttttagaatcagattgttaatttttttttgtagttcaaatttaactttttaaaaaattttatcattattatactttaagttttagggtacatgtgcacaacgtgcacgtttgttacatatgtatacatgtgccatgttggtgtgctgcacccattaactcatcatttagcattaggtatatctcctaatgccatccctcccccctcccccaaccccacaacactccccggtgtgtgatgttccccaccctgtgaccaagtgttctcattgttcaattcccacctatgagtgagaacatgtggtgtttttttttttgtccttgcaatagtttgctgagaatgatggtttccagcttcatccatgtccctacaaaggacatgaactcatcctttttatggctgcatagtattccatggtgcatatgtgccacattttcttaatccagtctatcattgatggacatttcggttggttccaagtcattgatattgtgaatagtgctgcaataaacatacgtgtgcatgtgtcttcatagcagcatgatttataatcctttgggtatatacccagtaatgggatggctgggtcaaatggtatttccacttctagatctctaaggaatcgccacactgacttccacaatggttgaactagtttacaatcccatcaacagtgtaaaagtgttcctatttctccacatcctctccagcacctgttgtttcctgactttttaatgatcaccattctaactggtgtgagatggtatctcattgtggttttgatttgcgtttctctgatggccagtgatggtgagcatttcttcatgtgttttttggctgcatgaatgtcttcttttgagaagtgtctgttcatacccttcacccacattttgatggggttctttgtttttttcttgtaaatttgtttgagttcattgtagatagccctttgtcagatgagtaggttgcaaaaactctctcccattctgtatgttgcctgttaagtctgatggtagtttcttttgctgtgcagaagctctttagtttaattagatcccatttgtcaattttggcttttgttgccattgcttttggtgatttagacatgaagtccttgcccatgcctatgtcctgaatggtattgcctaggttttcttctagggtttttatggttttaggtctaacatgtaagtctctaatccatcttgaattaatttttgtataatgtgtaaggaagggatccagtttcagctttctacatatggctagccagttttcccagcaccatttattaaatagggactcctttccccattgcttgttttttgtcagatttgtcaaagatcagatagttgtagataatgcagtgttatttctgagggctctgttctgttccattgttctatatctgtgttttggtaccagtaccatgctgttttgtttactgtagccttgtagtatagtttgaagtcaggtagtgtgatgcctccagctttgttcttttggcttaggattgacttggcagtgtgggctcttttttggttccatatgaattttaaagtagtttttttccaattttgtgaagaaagtcattggtagcttgatggggatggcattgaatctatgaattgccttgggcagtatggccattttcacgatattaattcttcctacccatgggcatgaaatgttcttccatttctttgtatcctcttttatttcattgtgcagtggtttgtagttctccttgaagaggtacttcacgtcccttgtaagttgtattcctaggtattttattctctttgaagcaattgtgaatgggagttcactcatgatttggttctctgtttgtctgttattggtgtataagaatgcttgtgatttttgcacattgattttgtatcctgagagtttgctgaaattgcttatcagcttagggagattttgggctgagacgatggggttttctagatatacaatcatgtcatctgtaaagagggacagtttgacttcctctttccctaattgaatgccctttattaacttctcctgcctgattgccctggccagaacttccaacactgtgttgaataggagtggtgacagagggcatccctgtcttgtgccagttttcagagggaatgcttcctgtttttgcccattcagtatgatattggctgtgggtttgtcatagatagctcttattattttgagttatgtcccatcaatacctaatttattgagagtctttagcatgaagtgttattgaattttgtcaaaggccttttctgcatctattgagataatcatgtggtttttgtctttggttctgtttatatgctgtattacatttattgattttcatatgttgaactagccttgcatcccagggatgaagccgacttgatcatggtggataagctttttaatgtgttgctggattcagttggcggtattttattgaggatttttgcatcaatgtttatcaaggttattggtctaaaattctcttttttttgttgtgtctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactttttttagttggtaaactattaattattgcctcaatttcagagcctgttattggtctattcagagattcaactcttgctggtttagacttgggagggtgtatgtgttgaggaatttatccgtttcttctagattttctagtttatttgcatggaggtgtttatagtattctctgatggtagtttgtatttctgtgggatcggtggtgacattccctttgtcattttttattgtgtctacttgattcttctctcttttcttctttattagtcttgctagtggtctatcaatttttttgatcttttcaaaaaaccagctcctggattcgttgattttttgaagggtttttttgtgtctctatttccttcatttctgctctgatcttagttatttcttgccttctgttagcttttgaatgtgtttgctcttgcttctctagttctcttttattgtgatgttggggtgtcaattttagatctttcctgctttctcttgtgggcatgtagtgctgtaaatttccctccacacactgctttgaatgtgtcccagagattcttgtacgttgtgcctttgttctctctggtttcaaagaacatctttatttctgccttcatttcgttatgtactcagtagtcattcaggagcaggttgttgagtttccatgtattttagcagttttgagtgagtttcttaatcctgagttctactttgattgccctgtcatctgagagacagtttgttataatttctgttcttttacatttgctgaggagtgctttacttccaactgtgtggtcaattttggaataggtgtggtgtggtgatgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactaaggacctgcttcatgaatctgggtgctcttgtattggtggcatatatatttaagatagttggctcttcttgttgaattgatccctttaccattatgtaatggccttctttgtctcttttgatctttgttggtttaaagtctgttttatctgagactaggattgcaacccttgcctttttttgttttccatttgtttgttagatcttcctccatccctttattttgagcttatgtgtgtctctgcacgtgagatgggtttcctgaatacagcacactgatgggtcttgactctttatccaatttgccagtctgtgtcttttaattggaacatttagcccatttatatttaaggttaatattgttatgtgtgaatttgatcatgtcattatgatgttagctggttattttgctcattagttcatgctgtttctttctagccttgatagtctttacaatttggcatgtttttgcagtgtctggtactggttgttcctttccatgtttagtgcttccatcaggagctcttttagggctggcctggtggtgacaaaatctctcagcatttgcttgtctgtaaagtattttatttctcctttgcttatgaagcttagtttggctggatatgaaattctgggttgaaaattctttctttaagaatgttgaatattggcccccactgtcttgtggcttgtagagtttctgctgagagatcagctgttagtctaatgggcttccctttgttgttaatccgacctttctctctggctgctcttaacattttttccttcatttcagttttggtgaatctgacaattatgtgtcttggagtttctcttctccaggagtatctttgtggcattctctgtatttcctgaatttgaatgttggcctgccatgctagattggggaagttctcctggataatatcccgcagagtgttttccaacttggttccattcttcccatcactttcaggtacaccaatcagatgtagttttggtcttttcacatagtcccatatttcttgaaggctttgttcatttctttttattcttttttctctgaacttctcttctcactcatttcattcattttgtcttccattgctgataccctttctgccagttgatcgcatcagctactgaggcttgtgcatttgtcacatagttctcataccttgggtttcagctccgtcaggtcctttaaggacttctcttcactggttattctagttagccattcatctaattgtttttcaagatttttaacttctttgccattggttccaacttcctcctttagctcagaatagtttgatcttctgaagcgttcttctctcaactcatcaaagtcattctccgtccagctttgttccattagctagtgaggagctgtgttcctctggaagaggagaggacctctgatttttagagtttccagtttttctgctctgttttttccccatctttgtggttttatctacctttggtctttgatgatggtgacatacagatggggttttggtgtggatgtcctttctgtttgttagttttccttctaacagttaggacccccagctgcaggtctgttggagtttactggaggtccactccagaccctctttgcctgggtatcagcagcagtggctgcagaacagcggatattggtgaacagcaaatgctgctgcctgatcgttcctctggaagttttgtctcagaggagtacccagccatttgaggtgtcagtctgcccctactgttgggtgcctcccagttaggctactcagcagtcagggacccacttgaggaggcagtctgtccattctcagatctcaagctgtgtgctgggagaaccactattctcttcaaagctgtcagacacggacttttaagtctgcagaggttactgctgcctcttgttagtctgtgccctgcccccagaggtggagcctacagaggcaggcaggcctgcttgagctgtggtgggctcctccgagttagaacttcctggcagctttgtttacctactgaagcctgagcaattgtgggtgcccctcccccagcctcactgctgccttgcagtttgatctcagactgctgtgctagcaatgagtgaggctccgtgggcataggaccctctcagccaggtgtggggtataatctcctgatgtgccatttgttaagcccattggaaatgcaaagtattagggtgggagtgacctgattttccaggtgccatctgtcacccctttctttcactaggaaagggaattccctgaccccttgtgcttcctggtgaggtgatgcctcaccctgctttgcctcatgcatggtgtgctgcacccactgtccagcactcctctgtgggatgaacccagtacctcagttggaaatgcagaaatcacccatcttctgcatgtctcacgttgggagctgtatactggagctgttcctatttggccatcttggctccacccctctcccagatagttaattttttaaaaacctgctgtgctggaaattacactgagttagtgatgaatctatacattaattgggggaagatttacattttaatgagaatgcattttttgactcctgtgaaatggtttctatttatataggtcaaatttaattttctcagtaatattttatagattttaaaatatggctttcctttctttttgagacagtttcactccaggctggattgcggtgcctcgatcttggcctactgcaacctctgcctcctgggttcaaatgattctcctgcctcagcctcctaagtaactgggattataggcatgagccactgcacccagctaagttttgtatttttagtagagatggggtttcaccattttgtccagagtggtcttaaattcctgaactcaagtaatcctcccggcttggcttcccaaaatgctgggattacaggcatgagccactgtgcccagccttggtgtttccttattttatcagattcatctgtatctcattttttaatgaagttataaatgacatttaaaaaaatttcaagttgattgtttactgctaggatataggaatacagctgatttttgtatgttgatttttgtatcctccctccttgctaaacttagacttacttattagttctagtagcttttttggtagatttgatcagattttatacatacaacaaagattatcaaatcttttcattctcaaactactttcttactatggataggaagtcttttagacttgtggcaaagcagtctctgttgcagctagtcaactctgccattgtagtatgagagcagtcagggaagttacctacattaataaactcagctgtgttccaataaaactttatttacaaaagccagaagctggcccagaggctgtagtttatctgcccctattatgtgatcatggttgtgaataaagacagttttacttcttctttccaacctggataacttttatttatttttcttgtctgacagcactggctagaatcttcagcacaatgcttactaaagtgttgaaagcaggcattattgtgtcattcctgatacggggaaagcattcagtttgtcatcatgatacacattaactgtaggtttattatagatgctttgtatcatgctgatgaagttcatttgtattcttaggttgctgagtttttttttctttttaaatcaagaatgaagttgaattttatcaaatgtctttatttactgagataatcataaggttcttctcttttagtgttttaatggggtgaataactgatattttaatgttaaaccaacctttcattttagaataaaacttattttcttaggatgtaggcttttaaaaagtatatcattggggccggacacggtggctcatgcttgtaattttagtactttgggaggtcaaggcaggaggattgcttgaagctggagttcgagaccaacctgggcaaaaaaatgagaccctatatttatttgtattcagtttgccaaaattctgtttagaaaattttaaaagactatgtaaatgtagttttaggttcacagcaacattgaaagtatggtacagagattgtctgtgcttcctgtccacagacatgcatagcttcccccattatcagtatctctcactatagtggtacagttgatatgattgatgaaccaaaattgcatgtcataatcatccagatttcatagtttatattagtgtgcactcttggtgttgtacattctgtaggtttggaaaggactgatattcatcattatagtattgtacaaagtaattttactgctctaaaatttatttatgtttcacctatctgccctttcatgccctcctcaaccacaggtaaccactgatctttttactgtatccatagttttgccctttctacaatgtcatatagctgaaatcatacagtgcatagccttcagattggcatctttcacttagtaatatgcgtttatgtttccatcatgtcttctcatgacctgatagctcgtttctgtttagaactgaataatggttcattgtgtaactgtaccagaggttgttcactcacctattgcaaggtatcttggttgcttcagaaatttgtgaaatattttgtcaatgttcatgagggagttttcttttttgtaatatcattgtttggttcagggtaatgctagcattatagaatgagttgtgttgtatttctcctctttattatttgggagagaggttgtgtaaaattatattacatctgcctaaactgtttgatagaattcactagcatagctatctgggcctggagttttctcaactttattttctttcatagatatagggtgatttggattatctatttcttcttgattgagctttggtaatttttattttttaaggaacgtgcccacttaatctaagtggtaatggttagttacataaagcttgcactattatcttgctattcttttaatatctgtagaatgtataaaaatgttacattaattatctctgaagttagtaatttattctcttttttatgatcagcctggctaggtcaaggtttatcacttccactgatgacctcaaagtatttggttttattgattttccctattgttctcctgtttcatctttgatgtcatcatcggtttggcctgctctcacaaaataccatagacttggtagcttataaacaacagaaactgatttcatacattcctaaaggctgcaaagtccaagatcaaggtgccagaagattcagtgtctggtgagggacaaattcctgatttctatattcctttatttcccctgtgtgcttcatatggcagaaggggtgaatgagctttctggggtctcttatataagaagggcactaatcccattcattagggcttggattccatgagctatcacctccacaaagctgcagtatctaataacatcacctctgtgattaagtttcagcatatgagttttgggaggacaaaaatgttcacactatgttctgatgtttattattttctctgcttctgttgggtttaatttgctctctttttttgtagtttcttcttttttacttacttttcgtttgtttgcttgtttttgagacagagtctcattctgtcatctagcctggagtgcagtggtgtgatttcagctcactgcaacctctgcctctggattcaagcaattctcatgcctcagcctcctaagtagctaggactacaggtgtgcaccactgcacccagctaatttttgtatttttagtagagatggggtttcaccatattggccagggtggactcgaactcctgacttcatgacccatccacctaggccaccgaaagtgctgggattataggcatgagccactgtgtccagaccttttttactttcttaagatagaagtcaaggctattgatctgaatgtcttccagtatagacattccgtgctaacttttcatttaggaactgttgtagctatattccacaaagtctaacatgtagtattttcatttttattcagttcaaaatagtttccaatttctctttgtgtcaccactttgcctaggattatttagatatgtgttactttgtttccaaatttttgagtattttgatgagctattttgttactgatttctaattttattcttttgtggtcagggaccatactttgtatgacttaaatacttttgacttaatactttcatgaagatttattgtatggcctagaatgtggtctgttttgctaagtgttccaagggcacttgagaagcatagtgttcttcaagtctactcttgtcttgctgattttctgcctccttgttttatcatgtattcagtacgcaatattgaaatctcacactatacctgtgaatttgtcaatttcttctatcagtttttagctcatatttcgaagccgttatgttaccaggtacataaacatttaagattatgtgttcttgaataactaaatattttatcattctgaaatgatgttgtttataactagtaatattttttgttgtgaaatctactttagtattaatataatgattcctgattagatttcttttgtcatctgtttgcatgggatatatttttcttccttttaaccaatttgtgtctttatatttaaagtgtgtttcttataggtagcatggagtaggatcttgctttttatacagtttgacaatttgtcttttaatttaggttattagacccatttcatttataatgtgattattgatatattaatatttaagtttatctgtcatcgcgctgtttgattttcattagtcccagctattctttgttcccttctttttctaatttcctttcaattagttatgtaacttttatggtttagttttatctctcattttttggcttattggctctatttttttttttgctatcttaatggttgcattacaatttgtactgtatgattttaacttatcacagttcactttcagacaatattatatcatatcacatatggcataagaaaatcagaatagtatgctttcatttcctctctcccagccagattcttcctggatttgtggaattatggttttcattaagtttagaaagtttctgttcattttctctttatgttttgtcattgtctctccctccctctttggggacaggtatattattgcttaaagtttttgcataattctctgatgtcccaaatttatgaatcttctcttttgtggtatctagtctgtatttacttctaccagtgtcctttccgtcatgactttgtttttgtttgtttgtttgtttgttttttgaaacaaagtctgactccattgcccaggccggagagcaatggctcgatcacctctcactgcatcctctgcctcctgggttcaagccattctcctgcctcagcctcccgagtagctggggttacaggtgcctgccatgatgcccagctaatttctttgtacttttagtagagatgggatttcaccatgttggccaggctggtctcgaactcctgacctcaagtgatccacctgccttggcctcccaaaatgctgggattacaggcatgagccaccataactggcccagtcctgacattttaatttgaattcctactagtgtaattttctttcaagaaatatcttccatgtctctacttgagatttatttggggacacagttgacttataaacaacttgatctttctggtcttgttttttgatttggtctaattttccactcctgaatcaaggtgtttctgataactctattctttgccctgtgaagtcttgagttttttcagcatcattcagacgaatggacactcttcctggtacactgtgagcaacaggcactgtttcttacaattttttaaggattttttccccctggtctcaagtagtttcctaggacaaatatactgttcattattctgctaaataaatacccaatgagattctcagcttcattgttcgaactcagagaatctggggctctacctcagtttttggtagactctacctcagttttttttccttcaattgtcatggcctggaaactttgccaagtcagggggctggggtgtttgtaaggcttatttctcttgtttcctatcttacagggttcattgtcttcattacctgaaatccttgttcttgaaaatcgtggtattatgtattttgtcttttttggttttgttttaagtgagaaggtaaatcagtatctgctgctccatcgtggccagaagcagactgcagcagagcttcagtacatgacatagactagctagaatgcttttctaccccctttacttaacagcttccttctcacccttcatttctcagtgtagcccgctcttccccaggggaatcttcctgagcccagtatagatcaaatcctgtgtgatcatagaactgttttcttgcagcatctatctgaatttgtaatttcacttctttgtattttttcttcactacacctaaagctaaacaagagcagagttactgtttgttttatctgcagagctcagtagactgtgttcgccatggtaggaactcagtgcatatttgtttggtgtatggatgggtgaaggttaaaatgcacgggactttatatccaaaaactactcttatattttatttccaccttgtttccccccgatgcagattctgctagcctatcaaaaatccaggatgcagttatttcagaagaacacttactagaactcaaaaatagccactatgagcaacttacagtagaagttgaacaaatggaaaatatggttcatgtactacaaaaatagctatctgaggcaaaagaaacacaattacagttagctcctcagaaaggtgaatgtgagcaagaacgctacagttcgaggtatgacattctagttttagagaaatattttaactctttattctaaatatatatgtgagaattgtgattgctgactttctggggcttaatgggagaaaacgtcttggtcttatggagtctgaaaatcttggaaataatacaacaaattcttaactgtgcttcttttatttattgcatatgcttttaaattgtgattttaatggctatttagaagtttaccatatagaaatctcattatttaacaaacagaatttggggtttttgattcttttgtattagaattaatgctgcaagaaatactttttattattactattatcattattattatgattattattattagaattttgctctgtcactgaggctgcagtgcactggtgcaaacatagcttactacaactttgaacttttggggtcaagggatcctcttgcctcaaattcctaagcagctcagactgtaggcacatgctcccatgcctggctaacttttgaaatttttcattgagacaaggtctcactatcttgcccagtctgatctccaactcctgacctccaacagtcctcctgccttggcctcccaaagcattgggattacaggagtgagccatcacgcccagcccagaatatcttttatataaatcattttctgcatttctaattatttactttgtataaagtcttcaatatagaattttttggttaaaatatagaaactttttcaaaaaggccttggatcaatatttctaaattgtcctcaagaatatttgtattgaatgcatgctgagcttaatacctaggtgatgggttgataggtgcagcaaaccactgtggcacatgtttacctatgtaacaagcctgcacattctgcccatgtactctggaaattaaaattaaaattaaaaaaagaatatttgtattaatttacagttcaaccaacagagcatgaaatggccatttgtctcaaaccagaatactttttaaaaactttatacagttttattctttttttaactctctgtttaaattgatttatttttatttcaatagctttaggggtacaagtggtttttggttacatggatcaattttatagtggtgaagtctgggattttagtgtacccatcacccagtaggtagttttattgctcacttttcttctccccttccttcttctgagtctccaatgtcattataccactctacctgcctttacataacctagcatagctcccacttataaatgagaacatgtggtatttgtcgttccattcctgagttacttcacttagaataatggcctctagctccatccaatttgctggaaaaaacattatttcattcttctttatggctgagtagtattctgtggtgtgtgtgtgtgtgtgtgtgtatatatacgtatctatacatgtatgtatatgtagatgtatgtatataagtatatatatacacacatagatatatggactcacacacatatatgtgtatatatatcacattttctttatgccattcatcagtcaatggacactggttgattccatatattttcatgttgtaattgtgctgcagcaaacatatgtatgaaggtgtttttttgagagtacgatttcttttgtagatatccagaaatgagaatgctgggtacaatggtaggatctacttttagttctttgagagtctccacagattttgtactaacttgcattcccatcagcagtgtataactgttctcttttcaccacatccacaccaacgtctgttgtcttttgatttttaatagtggccattatggctgcagtgaggtgatatctcattgttgttttagtttacatttccctgatgattagtgatatttagtatgtttttatatgcttgttcagcatttgctcatcctcttttgagaaatgtctattcatgtcatgtgcacactttttaatggaatcatttgtatttttcctgctgatctgtttgagattcttgtaggttatggatattagtctttgacagattcataatttgcaaatatttttcccattctataggttgttggtttactcttatgattatcaatttgcggtgctgaagctgaagctttttagtttaattaggtcttatttatttattttcatttttgttgcatttgcttttagggtcttcatcataaattcttcacctaggtcaatgttttcaggtcttagttttaggcctttaatccatcttgaattaatttttgtatatgataagagatagagatccagtttcattcttctacatgtggctatctttttttcctagcgccatttattgaataatgtgtactttctccagtgtatgtttttgtatcctttctcagagatcatttggttgtaagtggctttatttctgaattgtctattctgtttcattgatctatgtatctacttttataccagtatggtgctgtttttgttactgtggctttagagcataatatgaagtcagataatgcgacgccaacatgtttgttccttttgcttggtacatctgttgttattcaggctcttttatggttctacataaatgtcaactttttttataattctgtgaagaatgacattggtactttcataggaattgtatcaaatctgtagactgctttgggtactatggtcatttttcacaatatcagttctttcagtccatgaacataggatgtattttcatttgtctgtgtcatctattattttcttcggtagtgttttccagttatccttatatagatcactcacctccttcattaagtatattcctaggtattttacacttttgcagccattgtaaaagagattgggttcttgatatgactctcagcttggttgtatttggtgtatagttgtgccactgattggtattcatttattttgtaacctctgagactttactgaatttatttatcaaatctaggagtgttttgtaagagtctttggggttttctaggtataagatcatatcattggtgaagagatagcttgacttcctcttttaaatttggatgccctttatttctcttgcccaattgctctgcctgggacttcccagttttattcttaatatgcatgaaataaaagtaaaatggaaaatgattcacgattagtttatttcacatctctgtctcataaacagataaaattaattcaccttgaattaattttgttatatgttaaatacatatattatatgtataataaaaacatgtaatatattatatgtataataaaaacatatatgttaaaaacaaaatattagaccctgtcttgttcaaaagaatgtctaagttgcttataaaatacataggaattaagaatataagttaaaaatgtttccaaaaaataaacatgaaaattatgggttaacacaggggttcccaatccccaggccaaggaccagtaccagtccctggtctgttagaaactgggccacacagcaggaggttagtggcaggtgagcaagtgaagcttcatctgtttgcagtccctctccatcactcacattaccgcctgagctcctcctcctgtcagatcagtggtggcactagattgtcataggagtgtgacctgaaccctgttgtaagttgctcatgcaggggatctaggttgttcactccttatgagaatctaatgccttatgatctgtcaccatctcctgtcacccccagatgagaccatacagtagcaggaaaacaagctcagggcccccagtgattcttctacattatggtgagttatagaattatttcattattaataatagtagaaataaagtgcagaataaatgtaatgtgcttgaataatcctggaagcatccccccacctcaggtctgtggaaaaattaccttccacaaaaccagtccctggtgccaacatggttggggacagctggcttaacagatgtgagacccctttgccttttcttggattaatctgcaagatatacattgtgtgaatgatatctgatgatgacaccttggcctgtaaatcattttagggataccttcagtatctcatgaaaattaaaatttcttctagtgaagaacaaaatgatacccggaagcaactttccaaggaacagaatgctagaatattacaagatgagattctgactactaaacagaagcagatagaagtggccgaaaaaaaaatgaattttgaggtattttctttagtcattttcaaatgcttttatataaaatgtatgtatttaaaaaaacaactatatatttcagaaagtataaaggatttttaaatcacatatatatgtatatatgtatatatcatttatcatgtgtctatatatgtacatataggataaagccatgttcttaattcaactccatttgcctgcaacagttgagtagtgacattcacaatggcctaaatccaaagaagcatttgatattttccataagaattgatgatctttccaatatcaaaaataagttttgctaacaacagattttccagtttttggacattagttcatcttttaaaaatattaatagagaagtcagtttattattttcactgctaagaaagtaggaaatgtatagttgggtcagaggccatattgtggatatcattatccttacttttgaggacagtaacagtttgctccaagtagtttctcatttcaatgcaaagagctttgaaaacaatgacatgcatgatatacattgagtgataatttattgataagtattttgttcccagagaaagagttcagtatattttcctctatttcacacttattactgtttcaaacattataaagaagaaataagttattgcaatggcaaataatctcatgatttctaagaaaagctctataagttgtatgctaccattcatattttgaaataaaaggcttcttttgtatttatatatttacaccacagaagtaactgtgattttgtggaggatcactagaagtagcatcagaagacctggagaaaatcctgcatcttgtgtatatacatatgtgtatatttgaatatatatgtatatattcaaaaatatgtatatatttttgagatggagtctcgcactgttgcctgggctggagtgcaatggcacgatcttgactcactgcaacctttgcctccctggttcactcgattctcctgcctcagactcccaagtagcttggattacaggtgcacaacaccatacctggctaattttttgtatttttagtagagacagggtttcactatgttggccaggctggtctcaaactcctgaccttgtgatctgcctgccttggcctcccaaagtgctggtattataggtgttagccactgcaatcagctgcatatatatttttttaacttcttttaagaattgtgatcttaaatgagttcagtgtcgtacatagaggtgcaatgtttagatgcagatgtgtacaatgtagaagggtacaatgtttagatttaacagttatgaataagtgtaattctcataactgactataacatattagaaaagtagaatattgataaaacattcttgagaaaaagtaacttaaagaattttgagaaattgcttctgccctaacatatgtatagctaaggctcctacaatgttatggtttataggtgagatatcagagtgtaaacccaatttaaaaaatatagtcaaatgtattaatcttatattttatgcctctgggttttttgtaattcagagaaatgcatttacaattctgagtttcttaaaaatcctccagtgatttaattttcataatctttaaataaatatttagatttgtggagtttacactctattaggtttgaagttttgtccaacttgtttttaggtaaatatccactatgggaattctttcattatacaaacatacaggttactttttaatttcagaagaaattatgatatgtccctctattgagtgctaactaaaatttccctttgtttactcagatttctcttagccataaggaagaaaaagaactcttgcatgaaaatagcatgatgcaggaagaaattgccatgctaagaatagaactagacacaataaaacatcagaaccagctaagggaaaagaaatatctggagtacattaaaagtgtgaaagaaaagaatgataatcttctaaaggctatacaattgaatgaggaagcactaacaaaagcagtagttcagtacagtggacagcttagcattttgacaactgagaataaaatgctcagttttgaactgcagaatgtaagacacaacaatgaaacactggaaatggaaattcaatcatgtcattttagactggctactgctctacatgattgtgactgaagtcagatagcagaaagagacttctttccagagaacaagacatgaacaggtttatttacaggagacaatgaattctcatatatctaacctaaaaggtaacagtgagattctttctgagcaactctaatgctaacagtaaaattaacagcctgaaaattaaggtccatcacacaagataaactctgagagaaaagacggggcaggccaccatttttcctttttgggcaacttagtcattccagcctgcaggctttggagagtacaaaccgaccaggggaagaagacatcctgcagcacagcacagctgctttatcaaatcatggccagactgcttctgtaagcaggcccctgatcctgtttctcctcactggaaaggacctcccagctgaggcctccagctacccccaccagtgttccctggccaacagagatttaaatcccccctgggacagagcacccagagagaggggtgggtcaccacctttgctgtttgggcgactagccattcaggcctgcagactttggagagcccaagctgaccaggggtggaagtggtacctcagcacagcacagctgccctatgaaaatgtgaccagactcttttttaagtcagtccctgaccacatttgttatcactgagtggagtctttcaaccagggtctctggctaccttcagtgctgttctctggctgacagaggtttcaggccttcctgagtcagagctcccagggggaggaccagattgtcatctttgctgtttgggcaactcagccatttcagccttagggcttcagagtgtctgaggtgatgaggagctgaagtgaacccccagcatagcacagctgctttaccaaaaagtggccagacctacattttaagcaagtccctgttcttgttcctcctgattaggcaagagttttttccacttgcctccagccacctcctacaggtgtgttcagattggcaacaagtttgtacctcagtggtacagtactcccagaggaaggggcaggctatcatctttgccttttcacagccttcattggtgataccttcaggccctggaaaatatgaggcagttagggactggagtgcacccccagcataccacagcccccctacggaaaagtggccagactgttacgtgggtgccagtttccatatcttcttgatgggcaggtcttcccatcctgggtctctagccagcaccccactggagctaccaagccagtagcaactcagcaattccctggacagagcttccaggagcaactgaaatcctctatgccactgcctctgcagtggaactgtccttgctacccttggaatatcaagggagcaaagactttaagtgctgtattgacatgtccaacaagttgcagttgacccagtgagcaagccagtccatctcccatgggtcccacacactctccactgttcatcacccgacagggaacgctggcttgggcccacagcacagacactccatcctgggctgatcgcactaagtgattgctaactcacatctctctggggtggagcccctaggagaaaagccaagtggtagagcagcaagccagctgatgcggagcccaaagggcagggacagctatctctctaggcaccatttgctcttatgagacactttatcccagcactttaggagtgctgaggtcagaccagccacatcttatgtgcaagattgcccagcagagatcaggtctgagagttcccctcttaaaaaaaggggacttgcttaaaaaagaagtctggccacatttttgtagagcagctgtgctgtgttggggctttagttttgagagagttctcctctgagacctgatctttgctgggaagtcttgcatatgagatggggctggtctgacctcagcactccttagtctgtttgcctctcccagggccccagcctggccacacctgcttacagggcactctcaggtgctcacaccatagcttctgtgccagtggaccatgtctgaccaatggagggttgcagcaaggtggcccctacagccatggaccagcctgcatattgcctctacatactgcagctctttatatgcaaacttcctacatccctttgctggtgtgtgtttacatgggtgggttttgctgtacttgccctaccagcacacgggagtgcatcacacaccccaacccacaccaactgccattgaagatggagccctggcaggcacagagccaaaaatcccccacccccaccagcacctcacccttgacctaatgctgcagagaggaaaagggaccctcttatatcctgagggaccactgttgcttggggagcacagagaaggcacctagacccgtgctggccagcacctcaccccaaaccaacactatctccagtgcaacagcacacacagtcagcaggggccccctggtccccaccctagctgtcttgcctccaccactgggtgaatgcccacagggaggcaggcacttttgcatccgctagcactctgctgcagttgccgcactttggtcccctcagtgcagtggaccccaaacctcgaggagccagagaacaaagttggggcccagtacaatttcctcagagttaaagcacacagtccaggaattgggagctgaacactggctccctaaaatcctccagaaacaaagccagttggctgaatccacctgacaccacaatcaaaccctcaaggtcatcaaatgtgataaaagaaaagtactctgtccaaaggtcagcaaccgcaatggttgaaggtggataagcctataaagatgagaaagaatctgtgcaagaacactgaaaactcaaaaagtcagcgtgtcttctttcctccaaatgactgcatcaactctccagcaagtgtttggaactgggctgaggctaagatgtctgaaatgatacaagtagaattcagaatatgagtaggaacaaagttcactgagtgagagaagtatgttgtaatccaatgcaaggaagctaaaaatcactgcaaaacattgcaggagctaacagacaaaatagccattataggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactctgtctcaaaaaaaaaaaaaaaaaaaaaaagccattataaagaagaacataaccgacctgatagagctgaaaagcacactagaagaattttcataatgaaatcacatggtgattatgtgtgattgcattatgaaaattcttgtagtgtgtgtgggcacctgagagtgccctgtaagcaggtgtggccaggctggggccctgggagaggcaagctgactaaggagtgctgaggttagaccagccccatctcatgtgcaagaccacctagcagaatagaccaagcagaggaaagaatctcagagcttgaaaactggatttctgaaataaaacagggagacaagaacgggggaaaaagaatgaaaaagaattaacaaaacctctgagaaatatgggattatgtaaagtgaccaaatctatgactgattagtgtacctgaaagagatgaggaaaatggaaccaacttggaaaacatatttcagaatgtcattcatgagaatgtccccaacctagccagacaggccaacattcaaattaaggaaatccagagaacctcagttagatatgccacgagaaagacatccaaggtcaaaatgaaagaaaaaatgttaaaggcagctaggaaaaaaggtgaggtcacctacaaagggaatcccatcagacaaatagtggacctctcagctgaaaccttacaagccagaagagatattcaacttcttaaagaaaagaaattccaatccagaatttcatgtccagctaaactaagtgtcataagtgagggagaaataagattcttttcagacaagcaaatgctgagggagttaattaccaccaaatctgccttacaagagctcctgaaggaagcactaaatatggaaagaaaagaccattaccagccactacaaaagcccactgaagtgcacagaccagtgatgctaaaaagcaaccacatacacaaatctgcaaaataaccagctaacagcatgatgacaggatcaaatccacatatattattactaaacttaaatgtaaatgggctaaatgctacaactgaaagacacagcggggcaaggtggataaagaaccaagacccgtttgagtatgctgtcttcaagagacccatctcacctgcagtgccacacacaggctcaaaataaaggaatgcagaaaaatctttcaaacaaatggaaaacagaaaaaagcaggtgttgcaatctagtttctgacaaaacagactttataccaataaagatttatcaagacagagaaggacattacaaaggtggccctgacctttgataaatctcattattggttgataccaacctgggctgtctttttttgttgttgttttttgtttttacttttgagaaggagtctcactctgttgcccaggctggagtgtggtggcatgatctctgctcactgcaacctccacctcccaggctcaagcaattctccttcatcagcctcccatgtagctgggattataggtgcatgccaccacactcggctaatttttatagttttaatagagaccgggtttcaccatgttgggcagactggtcttgaactcctgacctcaagtgaaccgcccaccttgtccatccaaagtgctgggattacaggcacgggccactgtgcctggtcaatctgagctatatttattgctgaaaccaataggataatttgctgaggttgagaagtttctcccctccagagagtccctgatcttccaaaattaggttgagatctaaggttgattttactgtacaactccttttctgaagttctacttatttccaacaaggaatgcaagttttcctgcttccatgatgatggagagcaggcacctcctttcttaagtttcagcttgcagggaaggtgagtgtgaattttttcctgcttctaagatgatagagagtgatcatcagcctgagactttttccaggtaagtagctgaagtagagatttgtcttaaaaattttccttaatgactaaaagttaagattaccaaccaactggttttaatttctccttgcctttagaacagccagtaatcatatgaattgtgcatttgtttgttttgcttaacggtttttgtttgtatatgtttggggtttattgttgttgttttacttttctcccatcaagtatgatcatctcttcctgacttggtcaaatccaaaggaatgttccaaattgtgaggaacaaggcatcagaataggccaaaactcctgtagctgcaaaaaaaaaaaaaaaaaatccagttagaaataatttttataaaacttagaaaaaattaaaaaaaatttttttttcttaagaggtttcatgtacataaccaggccatcttttgccagccaagagcaaattgaagaagcagtggtggccacccagtgctaagattctgcccaaacaatgtttactacagcaacctgagtttgtttcctaagtctagttctttctggtttggtatttgtgttacttttaaaatgccagcagtttgtcctagctatgaggctgtagtaagagattcaaatgattttttttaagagctccatgataaaaagcttcattaaaaacaggtattatatatatgtaaaaatatatttaaatataattacatatatgtcaaaaatatataaatatatgacatatttatatataaacatataaatacacatatttatgttagaaatatgtttataatttgttatatatattttttgtatttgtgtgaatctaaaaggcctttctctttttggatttttttttttgagaaacatttgattttgttctcagtcaactgaattctatctctccattttacgtatgtctgtcctttctttttcttgctacccttaatgcccacataaaagacgtaaagtaatttctgataactggggattgcttaaaacagaaagggcaccagacttctttttgcaaggaatcactgtttttgtttctaaaatcccaatagttgtaaacagacaagtttttttgcagctcttaaactgctcactttttaaattgcattattggatcttaatggcttttttcttttttttttttttgagacggagtctcgctctttcactcaggcagactgcagtggcctatcttggctcactgcaagctccacctcccgggtttatgccattctcctgccttagcctcccgagtagctgagactacaggtgcccaccaccgtgcccggctaattttttgtatttttagtagaggcggggtttcgccgtgttagccaggatggtctcgatctcctgaccttgtgatctgcccgcctcgggctcccaaagtgctgggattacaggtgtgagccactgcacccggcccttaatggcttttgagggtttcaagaatcactttgcacagtgagaaagtttttgaccttggagtgtgtaatagctaagtaggagatatatttttagggctggttattatgggatatattttttcttccttttaactaatttgtgtctttacatttaaagtgtgtttcttataggtagcatggagtaggatcttgctttctacatagtttgacaatctgtgttttaatttaggttgttaggcccgtttcatttataatgtgattattgatatattaatagataagtttatctgtcatcatgctgtttgattttcattagtcccagctattctttgttcccttctctttctggtttcctttcaattagttatgtaacttttatggtttagtttcatctctcattttttggcttattggctctaattttttttttttgctatcttcgtggttgcattacagtttgtactgtatgattttaacttatcacagttcactttcagacaatattatatcatatcacatatggcataagaaaatcagaatttctattcattactactttcatttcctctctcccagccagattcttcctggatttgtggaattatagttttcattaagtttagaaagtttctgttcattttctctttatgttttgtcattgtctcttcctccctctttggggacacgtatattattgcttaaagttttcgcataattctctgatgtctcgaatttatgaatcttctctttcttggtatctagtcagtatttgcttccacccagtgtcgttttcagtcatgactttgtttttgtttgtttgtttgttttttgaaacaaagtctgactccattgcccaggctggagtgcaatgactcgatcacctctcactgcaacctctgcctcccaggttcaagccattccttctcctgccttggcctcccgagtagctggggttacaggtgcctgccatgatgcccagctaatttctttgtatttttagtagagatggggtttcactgtgttggccaggctggtcttaaactcctgacctcaagtgattcacctgcctcagcctcccaaaatgctgggattacgggcatgagccaccatatctggcccagtcctgacattttaatttgaattcctactagtgtaattttctttcaaaaaatatcttccatgcctctacttgagatttatttggggacacagttgacttataaacaacttgatctttctggtcttgctttatgatttggtctaattttccactcctgaatcaaggtgtttctgataactctattctttgccctgtgaagtcttgagttttttcagtatcattcagaggaatggacactcttcctggtaggttgtgagcaacaggcactgtttcttacaatttttttttttttttttgtgtttaactcatctgcatgtattttcttttttgcattttttttttaatgttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgcttggttttttgttcttgcgatagtttactgagaatgatggtttccaatttcatccatggattttttccccctggtctcaagtagtttcttaggacaaatgtactgttcattattctgctaaataaatacccaagagggtgtttttgcagatctccagtgttctttccctttactgctgtctcctttcaagtattctgtgatttctgtctgccttggttttttgagactctcggcttcattgttcaaactcagggaatctggtgggctctacctcagtttttggtagactctaactcagttttttttttctttcattgtcatggcctggaaactttgtcaagtcagggagctagggtgtttgtaaggcttatttcacttgtttcctatcttacaaggatcattgtcttcactacctgaaatccttgttcttgaaaatcgtggtattatgtattttgtcttttttgtttttgtttcaggtgagaaggtaagtcagtatctgctgctccatcatggccagaagcagactgcagcagagcttcagcacatgacataaactagctagaatgtttttctaccccctttacttaacagcttccttctcacccttcatttctcagtgtagccatctcttccccagggaaatcttcctgagcccagtatagatcaaatcctgtgtgatcatagaactgttttcttgcagcatctatctgaagttgtaatttcacttctttgtatttgttcttcactacacttacagctaaacaagagcagagttactgtttgttttatctgcagagctcagtagactgtgttccccgtggtaggaactcaatgcatatttgttttgtgtatgtgtggatgaaaatagccactatgagcaacttacagtagaaattgaacaaatggacaatatggtttgtgtactacaaaaggagctgtctgaggcaaaaggaacacaattacagttagagactgggtttcaccatgttggccaggctggtcttctcacctcaaatcaaccacccgccttggccttccaaagtgctgggattacaggcatgagtcaccgcgcctagccaacctgagctatttgtattgctggaaacaataggataatttgctgaggttggggagtttctcccctccagagagtccttaatcttccaaaatttggttgagatccaaggttgattttgctctacgactttttttctgaagttttactcatttccaataagaaggcatgttttcctgcttccatgatgatggagaacaggcacatcctttcttgagtttcagcgtgcttctgacagggagggtgagtgtgagatttttccttcttgtaagatggtagagagccatcatcagcctgagccatatttccaagtaagtagctgaattagaattttgtcttaaaaattttccttaatgactaaaagttaagattaccaatcagctggtttttatttctccttaccgttagaacagtcactaatcatatggattgtgcatttgtttgttttgcttaaatgttcttgtttacatttggtgttttattgttgttgttttacttttctctcatcaagtatggtcgtctcttcctgacttggtcaaatccaaaggaaagttccaaattgtggggaacaaggcatctgaattggccaaatcttttgtagctgcaaaaaaaaaaaaaaaaaaaaaaaaagttccagttagcaaaaatgatgttgtaaaacatttttttttttttaacctaagagttttcgtctacataacaaggccatcttttgttagccatgggcaaactgaaggagcagtggtggctacccaatgctaagattctaccgtattcactacagcaacttgagttttgttcctgtctagtgctttctggtttggtatttgtgttactttaaaaataacagcagtttgtctgagttatggtgtgttagtaagagattcaaaagttttttctaagagctccatgattaaaagcttaattaaaagcaactttgatatatatgtaaatttatatttataattacatatatgtcagaaatatataaatatatgacatatttatatataaacataaatgtacatatatatgttagaaatatgtttacacattatatttttaacctataattttttttgtgtttgtgtgtgtctaaaaggcctttctctcttcggatcttgttttttgaggaatatttgtttttgttctcagtcaactgaattctgtctctttattttacttatgcctgtcccttttttctcttgccacccttgatgcccacataaaagatgtaaaataatttctgataactggggattgcttaaaacagaaagggcatcagacttctttttctccaaatcactgaaatcacagattttgtttatcaaatcccaagagttgtaaacagacaagtttttttgcagctcttaaactgctcactttttaaattgcattactggatcttaatgacttttgagggtttcaaaaatcactttgcataatgagaaggtttttgaccttggtgtgtgtaatagctaggtaggagatatatttttagggctggctatcagaagagatatttgtatgcctttggctgcctggaaggtatggaaacatcccaatgctccactgaatagtgagactaccatgggatatgagctgattattgaatgggctaattggcttttcttggctaccaacctcaggggaaatgtagtgaaatgcatgttaaaaacatggcattgtctcatcccataatgttttcctcttttcagggcctgaggattttatgtaaaaatcaaatacttgatttttggatatctgttctgccttacagctgtgccttcatgttaggccctagaagctgcatgcttccttggccctgtttcttaaaaggctccagcctaaagccagtaagccaatttttaaaaatcttcaaggaaatcacatttaagtgtgtctgctttccttggccatcttaactgaacttttacaccatttttttttttggctttagtaaaatataaatcctccatcttgtttcacatgagtcatctctttaaaaatgcaaatttagaattgcctcactaataactgtttacagtagggaacaagtattcaaaagacgaatgtgctaaagtggagaggaaaaactggcaaatgaaaaatcttttgaatccctaagatctacttctgtgtgcctatatgtctaaatatttatatgaattatgcatgtaatgtttgaataccaaaaatatgtgaaaaggctctaattggctttttaaaaagttcttaaatattgtatcagaaattagaaattagaaacttattcccaaatactttttcaagttttggttaaaaagaaacttcaagatgtcttcacaatagttagcatacattattgtttagatgtattggtccagtggtttttttccttttttcttttttttattttctggtcaagtggttttattttatatcttctagctactataacatgtcaaaatttgccacaaagttacaaactataaacccagacccaaacaataatttttgttcatgtaatttttgataaatatttaatattgttgatttaatgaaaacagctcaatccagagttatcagtaaataaaactattaataataagttaggtaaatgtaatagaataaaagcttataaatgaacttgtcatataagttaaatcttaacattatattaaatcaaataatagatattagatgtctggatcattatcaatttttaaactatattattggaaacattttcaaaataattataagatagtcctcatctataaaatgctgatgtgacaataaagatttcttacttcttaggttttcaccaaaaatttattaccaaaaatcaaaattttagttaatatgtgattttacatataaagtgtgccaaaataagttttattctgatgaaaaaagaaaaattgtgagaaataaaaatgaaataaagaaatgataagaaacagaatgaaaataattgttgtccaattcaaagattattgaaggattccttatgaaacaatgtaaagggaaccagtaagtgacagagagatttaaagaaagttataaagagattataaagagatacattcagtaagaaataccacaaagatgctgggcacggtggcttatgcctgttatcacagcactttgggaggccaaggtgggcagacaagatcaggagtttgagaccagtctgtccaacatagtgaaatctcgtctctactaaaaatacaaaaattagctgggtgtggtggtgtgcacctgtaatcccagcaacatgggaggctgaggcaggagaatcacatgaacccagaaggtggaggtttcagtgagccgagattgcaccattgcactccagctcaggtgacagtgtaagactctatctgaaaaaaaaaaaaaaaaaaaaaaggaattattacaaggaaaataattttgtataaaaaattgtatggtagatttttatcctaaaacaaaatggctggttatttaagaaagaggatatttaggacaaaacagaaagtctaagcatgttataattggtctgtgtaataatacgcttcattaaaaagaaaattcttttaagaattttgtgtgtgattcagttggctagaatggaaggaaaattattcataatagcctttctgaaaaattaagctttgatttttaaaatacactagaagaaaacaaaaaaattgattagaaccacaagatgcttttaagcattaatttaataaaattgtaagattttttaatgtttaattctataatctgtttctaaaaggtttctcagatgaatatctcaaaagtttaatttttgctgaaccccattgcttccagcttactcagcttattctccctttgagaaacctgggatagtaactctcttcttcaacttttcttgactccagtagcattttttttcttcctccaattctaaatctgttgttatggcctgatgatgaaatgttttatcttgaaaagtatttttttttaaaggcaatgttttcctccagtataagttaattctacactgttgccttttcttaatatgtttatgggccttgagccctctgaaggttagcttaaaaatcaactcagaaaagaccaatcgattaaagagaggacaggcagatttgtttctgaatatatacatgaaagttttcaaaatagaggcccaatatataggagaaattgtctatttttcattgtttagtttcaacaaattatggaaagccttgtaaacaatatgcttgaaaaaactttataatgtagttctggtggactttgagggaatatccaagaaggcctgtctctctagattcttctaaacctttctgagttagcatttcttctttttagctatggggcacctataacctatagtacaacaaggaaggtcagataagttctttatggccagttcttagacagaaatttgaagaaaaaattagattaatactttaaaagttttatggctggctctgaacaaaaagttacagattctagggcccacctggaaaatgaagattctagtttctgtggccaggcttgagggaaactggaactgaggaacacaaggacaggagaaagccaaataaaaagttttatttctgagggtgcttctgaaggtttcattttggggtattgtttttttcagtccaacatatgtccaaagtgttcaatataattaggcaacttcccatgctgtggctaagagtcacatattctgctcaagacttctatgatatagtgtttgcatgttacactgggcatactctttctgtatctgactagttcacgttttcttttcatcaggtttgactgtcaggttgtccaaataggcttcccataaaggagaaacagtcactgaagaaggttacttttttcttttattgttaactaatcaacaaacactttaagataattcctgtgttgttttaattagtttttaaaaattattacaaaactaaactttaacagggttaagggccttacatccatgtaacttcctatattgctgttaagatcttttcatttcactctggttaaatgaagaactattattttataatggcccgtgattctgttgtaatcaaacattttgagttttctaatatcttttgacaaacagcctcaaatatcaaatactgaataaagtctctgacttagacttgtagctggtggcttatcaaaactataaaaattaaccactgcaaggtcataaaatcttcttacagcttccagttaagtcatgaactccagtatcaccctctccaggctgatgattgggcatcagctgagagactcctccagcgccattgaaaagggtttttatcaaatagtgtaaattaaactttttgctgttaagttgcagggctttgactcctgagtacttctatctcatctaaaaggtagcactggctcctgctgaaacttaaacatcaatgctgatatctggcaccaaattctagttaatgaaagccccaccttcaaacctgggagaagatgagagtcaaaacaacttgctaatgctatactttcatgggtcatttctatagtttgttattagagaagtttctctgaatgtgttgagcaccagaaaccacgaggagatgcagcattctctcctgaacgggaagccagcttttggcattgctttgatgcaactaccatttgccattgatggcaatgcatcgcttcctctaggagtgtaagagggagtggatgcagtcagagtggttttttaaattaaaaaaatttaaaaaaaaatccaggctgggcatggtggttcacacctttaatcccagcactttgggagaccaaggcaagcggatcacttgagctcaggagttcaagatcagcctgtgggcaacatggcaaaaccccgtctctacaaaaaatttaaagtagctgggtgtgttggaatatacgtgtagtcccagctacttgggaggccaaggtggtaggattgctttagcccaggaggttgaggctgcagtgagtggagatggtgccactgcactccagcttgggtgacaaagtgagaccctgtctctctctctctctctctctctctctctctctctctctctctatatatatatatatatatatatatatatatatatatatatatatatactttcttgtgatactgtgctaggcctctatacaaagacataaatactaaatcattttcctctattttaatataatttgttctatgccttaaaactagataatttaaatgtttagctacctgtgggttttttttttctgttattgtcagagctaggcagggcttatgtcctttgtgtttaaacatttttaattctgggccaggtgcggtggctcacatttgtaatcccagcactttgggaggccaaggcaggtggactaattgaggccaggtgttcgaaaccagcctgtccaatgtggtaaaaccctgtctctactaaaaatacaaaaattagctaggcgcagtggcacacgcgtgtaactccagatacttggggggcatagagaggaggatcacttgaacctgagaggcagaagttgcagacagctgagatcctgccactgcattccagcctgggtggcagagcaagactgtacaaaaaaatgccaattctatatgtagcttataaaattgggtaaaacaacaaaacttacctttctctttctatgtggtatttccaaaatttaaaactattttaaatctcactgggcccaatctatttttattgctaatgtaccactgctaaaacgatataaacaccttttcttacaggtgcaggcactcatgtagaaaaattgagcatgtggaactgtaagggccagttttgagagataaaattagtttagccccttcaaataaaggacaggcacacatgcctaaacagctgacaaaataagaaactttgcctcctgggttctttccattcatcctaatataaagaattacctactctccataaaattaaaaaagaattacttacaggatattaagatacttaagtgacaaagcctcctgggtagagtgctccaagttatgaaatttttacagatacatatagaaagctgttttaaatcagcgatcttagtacaaattactaaaaagactacacaccaaaaaactttgtggaataacagaagtgtctaaattccttaacttaaatggttttaataaaatgtttgtgtttcacataactaattactatagtttgtaactaaaaccaaaattatgctagcttaacacacagaagttgttataagaaaaacttcagccaaattaaacttcaaagaatattgagcaataaataatttgcaaattggtctgcctcctgagccagagtagactcagagactcagtgaagctgtgtggtggaagaaggtttatggacagaaaaaggaaagtgatatacaaaaaattgaaatgaggtacagaaacacctggattggttacagttcaatgtttgctttatttgaacatggtttctacatttgattagccaaatctcagtgattggcacaaatgtaggctacagtctgtttacaagtttacttgttatagttcaaggacagggaaatctttggcctaaacatttaggccaaacttaacatttgtagggaggcagctttaggttaaacttaacaatttccctctttggtcatcttctcaattttgagagactgacaaaaatttagtcattgatgtcactattagtatgtacttacttggtcttgaaacccactgggaagtgggttttgtaaggtgggagcagttggttttgtaaggtgggaacaaggacttgggattattttattttatttttatttttgtaagggttatagtagagggtacctccttatgctggaacatctttttatatgagaaaaaaacaaaacctgatccattctaggatctgtgtgtttccttaaagtcttagtttatgtcatgagtgactcagtttggtttggtctggtctgttgaggcctgatgcatgagctgagtccaaaaaaatggcctctcataactttgtttaaaaattctccccttttggtcaggttctcacttaggtgatttagactgtgaccaaaacttagggtctgagtgccactcttagttgccatcactttggatttctggtctcagcatgccatttataggttacagtgtcctcatggtcacacatattttgtttcagctcttgtcattccagttgaagagagatcatttgacattccagagatggctgcatggaaacattcaaaattttaaagagaatacagtgtaccaggaagactattattactatcagaaagataataacaagattttggagtagttccttacttagtgtcctcataaaccaaaccactgaaaatcaaaagaatgagctaaagagtctgcttgattaactaagcagtctcttcattaaaactctacaaatccatataatacctggtgtgatgtatttctctgtaggccacacatgccagcagctgcacagataatttctctgtttagccagtaagtaatctagagcaattctatcattgagcataactttcccaagataaagtctgttgtgtaactttagcctttacagtagaatctgctataacacctatcattagggatacatttgtaatcattccctcttgtacttcaaaccatggagaaaatagggcttaacaaatgatgcccttctagaagagtgaaggcctcctctcaatgctctcttaaacccatgatgtaggttaagaggagtgaacaaatattctgtttctgactgattatgaggcaacatacgtaccattaaaatttctcacatttggcctctatcttccatcaaagaataaggttatccagatgtgagggtaatctggctgtgacatctgtcactcagttgatctccagggttgatttggctgatctggctggccaggcacactttcccttcctccctcaccactccatgtgcatccctcctgaagctgcatgctcagtccaagaggatgaccatctctgttagaggaggaccattctttggtcaagggtatacgagtagctgcactcccctggtagaacttccaaacaagctttcaagttataaagttgtatatgtataagactagctacaaaatctatcacaaaagtatatcccatgagtgtgcacaacagaccccccctttcacatctattgttcataaaggcataagcaagggaaaaaaatattcagaatctaatgttagcagagcagtctttatccgttgttcacatcaagtttgccatcttctggggagaaacttttctggttagctttaccttaagggttatagtgggtgtacagtttcaagactgtggagggacccttcttagttgtaagattatgaacccagagttcaaggttccaaagcttttctgtagtgtggatgtcaagggcagtctttctctgatgttctcagaagatccaatctataggctctagattatgaagaggtgttgatctcagtgaatcataaaaaagctttttttacctggtgaaaatacactgtggcataataatctgttataacatcagctctcttgcatgggaaagctttaatacaaccagaaaacacgcactgaaaatgataattcaatgaaatccctttataaatgtttaaatggcccatcaggtagtggattgtatctgaagctttcattgtccttccaggaatatgagtttgacaaaccaaacattggtcataagctattttagcaatttagaattcaccacaccaatatatatttaacttggatcattttatcttttctatgataagtcatggaatgcagaacttttaataatgaaagctttaaggatggactcaggaaggataaggcagctgtcctggttctccatgagtccatgcttaacattgaacttatgtagtcttgaattccagttgtttctccaatttaggtttatagcagtaacaactgaagggttgtcataggtaatttgacttagaccaaggcgttcattcaaactgtgtatttaaacaatttcagtattggttaatttagcgtgaaagtctgacaatgtgttttcttggtattcagttaattttcgttctacttttaaaaacaagtaagtcttttcgttaaagttccaggtactctgacacagtccaaatgatatgattctaaaatttccagaaatctgtattcaagagctcttttcagggtctttccatcctttcaggaatctcccaaaagacaccatattctgggacattttgggcttgtgaagttttcagaaactgcatcagtattaagcaattaactgtggaaatgatgttaaatagtcatagttacccaattaacaggaaaatttggttatttctgtggtctacaatttatcatgataaccataattataattcatagcatatgtttatacatattagaattttagaaattccatataattttggaacatatattaacattcattagaatataacctgaataaggttaaacatttcttattttgacagtgtttcccatgtaacttaatgtgtcaaataatcctgtttacccctgttttgaattcttcagggccctctgtagcatcccaaagttagaagtcaaaaagacttaattttgaaactgaaatttgattttgggaagcccataaaatatattaaaggtttaaaacacttgatattataaagtggaattccagatcacaatgtcattcatttagccaaaatgataactcaaaaaatgtttaaaggcaaaaacccttactcattgatagatgacttagcttttcaagcaatctgtctttcccctctttttcctgtagtttatttggaggggaaaaagacatcttttattatcctttagtattacatgaaaatcttattcaaaagagaaagccaaatttcatccttgcattagtgtactattaaagtcaactccaatttttagtaaaaccttatagacaaatttatccagtctttatcagtttgaccataaggtgagattctcaaaaacttctgataatgttttacaaatttgcattaaagagcagatgagtgctctaagaaaaccctgttttgatttcattccaatgttcaatttatggaaaagctgaataatactcctttaaatttaaccaatatgttcacacacagtatttctcttacaagattatttttttcacaaaccttccacaacttgctcaaacttttagctttattttatctaaattaaaacaatcctttaactctctaaattaggcaaaaatttacattttaatgccttcttataatcttttactgaaagcacatttcactttcctcacacagcttccatagataacttttttcagtagtctgaattacatgttacaatgttaacccttagcaatttttatttttggtgaaaaatctggcaagtaagtgactttaattatgtactaggtgtggagcctaggacaccagacagaagtgcagataaagtctgaccctttcaagcatagccaggggcatggctaactccacatgtccccaggcattacctagaatctaatggctccagagcaggtaaactgaacagattttaaaactcaaggaagcagtttattactttaaagcattttacagacctaatatctgacctgcctaatttagaccaaatgtctttattttaccaataaactttaaagctatctttattttcaaagcttactaaagtcatgtgaactaaaaggcattacagtttttatttctctgaaaaaaatttgatttaagcactcattgtttttaagccaattagagcttttttatttataaacatcacacacaacacatacacagaagtagacccagtagttgtaagacttttcatttgccagtttttaagtttcttagttggattactagcttcagggtggagtcccctgaggaagaaggctaggaaaatatgcagtttctaggacctaataaacaggcacaactgaaaggcaaaacagatccccaaaaatttagggtcccattttatactggatccccaaagagaaatgctatggagcaggacagttcaatgatccttaccatgcattttgttgcagagcaatagaaagccaattagttcattttgtgatcagcccatccctatgggagccttatttctcagtggtgggggaacattgtcatactttctaggtaatcgagaatgtgcttctctgattgagatgtgcaaagagctgaatatccccccataactgccatttgccatcccccaaaaatatatttagccttagactttgtgaggaatctatctgctttcaattcctgggatttcatgaggaaaacaggtttttcccaaaatggggtctgtggtgcctcctctgtttttcccaaggagtcccaggctgttagaaattaatcttatgtcctctcatgcatgcatcaagtttggcaagccaaaatggagaaaaacaattgagttgactgaagagaaaaaagagatccaagaagagaaaaaatcatgaaggacttttaaatacacctatatctttgatatcctattttaattaagctgacttttaactatagtgctctttaaaaaaatcgttttaaatctcttattacctgactttacctaggccaaacagccaatatttctggcttttgaacttttacaaaattaatctcccaggtgaaaccaataagtcataactaaggttatgacttaaccacgagtgatgaggtattttcaaagaggtagtaagcaatttttacaaaatctaaaatctccaaaaatagcttagagaaagaaaaattcaagatggatgtcagaagttgtttatggagagaaagagaatcaataaatggcaaaggtcacacagatatcaaaccagaaaggactgattccctgagccaagaattgaaaccaggttgccgttgtaaaaaggcaaaaccttagccactaagccacagtattgggtagtttccattgttcttcccagaaggagcctagagcagctgattttgaacttgcagaggcttttaactgctcaagataatttttagaactatgacatgaactctaaaattcctgccctccagatggtggagaccaaggaaagtactaccatgtggtaacaaggtcaagctcccaaggacataaaactagatgagagggaaacctcatctttatttatatatttatttatttatctttttttttaatgtttcaggaagctgcagcaaagtttgtaaatgaccagtttgctgggctggcttgaacttcgagcttttgggggtcctaggcctgcattctatccaatggtacccccacagaccaattggtagcacaaagtacaccaggtttgccatagtttaagactagtcacacatatccttgttttcattatttaaaactttgcagaggagactgatttttaccatttctacaactagttcacacacacacacacacacacacagaggccagaagtctgaggatacccttttggaggcatgtcaggcttctgggcttcctttcccttagtgttcctagcaaccctgctcactgcaccatagcctggggggcctaactttttctattttataaaaccataggtataggtgaatttaaaatgttctggttgagaattggtggagtttgtctaaagacctgggattcatagaaagggaatattcaggttaagataaaggttgtggagaccaaatttcttttgaagtcttatagtggctgccctgcccttagagacaatagatgacaaatgttttctattcagatttagttaatctctttacatttgggggggtctggaagaaaatgatccagctatattaatagagattctttacagatgtaaattctcccctacaaataacaggtttgcagggccatttcaagatatggcaaagaaatatgttttgggataaaatattttgattttcttccttgtctcataatgttatgccagagtcaggttggaaaataagtcatgacatacaagtttaaataaaacccttctgatgggaatttacgttttgtaggacatgactacccagaccctttagataggaatttggacaagataaaattagagtttagccctcaaacatttaaactggctataagccttttggctttaagtctgttggtcatagcagccccaccaaggaacagaatgattccagggcagggagctgcaccaccctgacaacagggacaaaattaaactttgacttttttgtttgtttgtttttctgggacagagtcttgctctgttgcttaggctggagtgcagtggcatgatcttaactccctacaacctctgcttcccgggttccaacatttctcctgcgtcagcctcccaagtagctgtgattacagatgcccaccaccacacctgactaattcttgtgttttttgtagagacagggttttgccatgttggccaggctggtcttgaactactggtctcaagagatccacctgcctcagcctcccaaagtgttgggattacaggtgtgagccactaagcccagccaaagtttgactattgatgttgccttgcaaatatttgccagaaagagcaggatgtaaaccacaaataaaattctaagttccccaactgactaagtggacctctcagccaaggaggaccaaacaaacctgaaacactagctcaggccatgatgggaagtgaggatagacatgcctcattgtacccttctatccttggacttgaggcccgagtaaacagtattaacattacaattataactgacataacagactctgtaacaataagaccagctccaacctgactgtggtataacttcacatgacaaataacaggccctaaaagaaaaagtattgtaagccaaaatatattactttgacatattttgaaatggccctgcatgtctgtctcttggggaaatttgcattctctaaagaatctccctccctcactaggtctctccagagagtctgacacctctgataagagatattcatatctattctctctgaaacctgctatctagaggcttcatctacaagagaagaaccttggattctgcaaccttccccccttaactgaagctgattccaactaggtgatactaatttacattgcaaacaatactgtttatgcattcacttttttctggatcctcaccaacattttttttttctttttaaattttaaaaatagccattcaaactggtgttaagatgatatcttactgcagcttaaatttgcatttctctgaagattagtgatgagcatcttttcataagcttgctgcccacttgtatgtcatcttttgataaatatctgattatgtcctttgcctactttttaatgttttttgttgttgttgttaagttccctatagatattagatattacttctttgtcaaatgcataatttgcaagtatttcctcccattgttcaggtagtctgtttgctgtggtaattatttcttttgctgtgcagaagctctttgtttaatataatcccatttgtgtattttttactgttgtttcattgacttagttataaattctttgcataggccaatgtcctgaagaggttttttaggttttcttttagaatttttatagtttccagtcttaaatttaagtctttaatccattttctgttaatttttgtatatggtgggtatagggattcagttttattcttctacacgtggctgtttaatttattttaggacaagttatatagattgttttttctatacatatgtacatatgagggccctggtctgttccattatcctatgggtataattctgtaccatcatcatgctgttttggttactacagtcttgtagtgtaatttgaaatcaggtaatagggtgccttcatctatgttatttttgcttaggctttttttttcattccatgtgaatcttaaattattttactaattctttgaaaaatgatggtaatagtttgaccagaatgcattgaatttgtatattgccttggacagtatggtcgttttaatgacattgattctttcaaatccatggttataggatattttttacatgtttgtttcatctatgatttctttcatcagtgttttgtctttgcctggagtgtagttctcctaacacagatcttccacctccttgactaaaatgaacttctaggtatttcatgtttgtgtggctattgtaaataagattgagtccttgatttggttttcagcttgaacattaatgatgtatagaaatgatacttctttttgcacatttattttgtatcctgaaacattactgaagtcatttatcaagtctaggagtttcttgtaggagtctttagggtttaccaggtataagatcaataagcaaacagagataatctgactttctcttttccaatttggatgccttttatttctttcccttgcttacttgcttagtctaggacttccagtagtatcttgaataggagtggtaaaatttggtatccatatcatgttccagttcttagggagaatgcttttaacttttgcccataaatatgatgtagggtgtgggttcagcatatgtgacatttttttgagaaatgttccttcaatggcttgttttttgagaatttttatcatgaagggatattggattttatccaatactttttctgcatctattgggatgatcttatggtttttcttcttagttctctgtgtggtgaatcacatttattgatttgcatatgttgaaccatccttgcatcccttttttttttaatttctgtgttaattttttttttgtttacccaaagatcattcagaaatggtgtttagtttccatatatttgtgtagttttgaggtttcctcttggtattgatttctaattttattcaaaattagaataagattactgtagtctgagaagatatctgatatgattttggtctttttaaatttggtttaaagttcattttaagtgaagactttccttgtggatttttatcctcgatgatttgtctactgctgtcaatgggtgttgaagtgccctgctattactgtattgctgtctatgtctttccttcagtctatttgtatgtggttaatgaacctaggtttccagtttggggtgtatatattttaagaatagttatatctttttgttgaattgttgaattgaatcctttatcattatgtaataaccacctttttttcccactgttcttaatttaacatctgtattatctgataaaagtacaactgcttctgctcattttcattttctgtttgcatggtacacctttatccaccccttgactttcagtctaagtgtgtttattcactaggtgattctcttcttggcagcaaatggatgaatcttgttgtcttacattcaatttgccattctctatcttttaagtggagcacttaggccatgtacattcaaggttttcattgatacttgagattttgttcctgtcatagtgttgttacctagtttcttcagagtctcaattgtgtcatcatattgttacctagtttctttggagtctcaaccacttcataggatttgtgaggtttgtactgatatgttttttaaaattttaacaattatttatttatatatttgtgtgagacattgtctcactctgtcacccaggctggagtgcagtggcatgatcttggctcactgcaacctccacctcctgggttcaagcgattctcctgcctcagtctcttgagtagctaagattacagacatgtgccaccacacctggctaatttttttttgtatttttagtagagatgtggtttcatcatgttggccagactgggctcaaacccctgacctcaaatgatccacccaccccagcctcccaaagcactgggattacaggccactgctcctggctaacaatgatttttgatgcagaggtacatgtgcttgatcattgcaagggtatattgcacccagttagtcagaatagtactcagtaggtagtttatcaatccatattcctctttcttcctcctcactctagtagtatatatattttattcccatgtttatgtctcagtgtggtgaatgtttagctttcactcataagtgagaacatgtggcattttattttctgtttctgtgttaatttgcttaagattatagcctccagttttatccatgttgctgataagaacatgattttattccttttatggttgtgtagtattccatggtgtatatggaccacaatttctttttttttgtttaattatactttaagttttagggtacatgtgcacattgtgcaggttagttacatatgtatacatgtgccatgctggtgcgctgcacccactaacttgtcatctagcattaggtacatctcccgatgctttccctcctccctccccacaccccacaacagtccacagagtgtgatattccccttcctgtgtccatgtgatctcattgttcaattcccacctatgagtgagaatatgccgtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgtcgtaataaacatacgtgtgcatgtgtctttatagcagcatgatttatagtcctttgggtatatacccaggaatgggatggctgggtcaaatggtatttccagttctagatccctgaggaatcgccacactgacttccacaatggttgaactagtttacagtcccaccaacagtgtaaaagtgttcctattactccacatcctctccagcacctgttgtgtcctgactttttaatgattgccattctaactggtgtgagatgatatctcattgtggttttgatttgcatttctctgaaggccagtgatggtgagcattttttcatgtgttttttggctgcataactgtcttcttttgagaagtgtctgttcatgtccttcgcccactttctgatggggttgtttgtttttttcttgtaaatttgttggagttcattgtagattctggatattagccttttttcagataagtaggttgtgacaattttctcccattttgtaggttgcctgttcactctgacggtagtttcttttgctgtgcagaagctctttagtttaattagatcccatttgtcaattttggcttttgttgccattgcttttggtgttttagacatgaagtccttgcctatgcctatgtcctgaatggtaatgcctaggttttcttcaagggtttttatggttttaggtctaacctttaagtctttaatccatcttgaattgattttcatataaggtgtaaggaagggatccagtttctgctttctacatatggctagccagttttcccagaaccatttattaaatagggactcctttccccattgcttgtttttgtcaggtttgtcaaagatcagatagttgtagatatgcggcattatttctgagggctctgttatgctccactgatctatatctctgttttggtaccagtaccatgctgttttggttactgtagccttgtagtatagtttgaagtcaggtagtgtgatgcctccagctttgttcttttggcttaggattgacttggcgatgtgggctcttttttggttccatatgaactttaaagcagttttttccaattctgtgaagaaagtcattggtaacttgatgggggtggcattgaatctgtaaattaccttgggcagtatggccattttcacgatattgattcttcctacccatgagcatgaaatgttcttccatttgtttgtatcctcttttatttccttgagcagtggtttgtagttctccttgaagaggtccttcacataccttgtaagttggattcctaggtattttattctctttgaagcaattgtgaatgggagttcaccatgatttggctctctatctgtgtgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgaataccctttatttccttctcctgcctaattgccctggccagaacttccaacactatgttgaataggagtggtgagagagggcatccctgtcttgtgccagttttcaaagggaaagcttccagtttttgcccattcagtatgatatcggctgtgggtttgtcatagatagctcttattattttgaaatacatcccatcaatacctaatttattgagagtttttagcatgaagggttgttgaattttgtcaaaggctttttctgcatctattgagataatcatgtggtttttgtctttggctctgtttatatgctggattacatttattgatttgcatatattgaaccagccttgcatcccagggatgaagcctacttgatcatggtggataagctttttgatgtgctgctgaattcgttttgccagtattttattgataatttttgcatcgatgttcatcaaggatattggtctaacattctcttttttggttgtgtctctgcccggctttggtatcagaatgatgctggcctcataaaatgagttagggaggattccctctttttctattgattggaatagtttcagaaggaatggtaccaattcctccttgtacctctggtagaattcggctgtgaatccatctggtcctggactctttttggttggtaagctattgattattgccacaatttcagctcctgttattggtctattcagagattctacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgcgtctatttgattcttctctgtttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaatcgtgatgttagggtgtcaattttggatctttcctgctttctcttgtgggcatttagtgctataaatttccctctacacactgctttggatgcatcccagagattctggtatgttgtgtctttgttctcgttggtttcaaagaacatctttatttctgccttcatttcgttatgtacccagcagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttcccagtacgtggtcaattttggaataggtgtggtgtggtgccgaagaaaatgtatattctgttgatttggggtggagagtcctgtagatgtctattaggtctgcttggtgcagagctgagttcaattcctgggtatccttgttgactttctgtctcattgatcggtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttattttccatttgcttggtagatcttcctccatccttttattttgagcctatgtgtgtctccgcacatgagatgggtttcctgaatacagaacactgatgggtcttgactctttatccaattttccagtctgtgtcttttaattggagcatttagtctatttacatttaaagttaatattgttatgtgtgaatttgatcctgtcattatgatgttagctggttattttgctcattatttgatgcagtttcttcctagtctcgatggtctttacattttggcatgattttgcagcggctggtacccgttgttcctttccatgtttagcgcttccttcaggagctcttttagggcaggcctggtggtgacaaaatctctcagcatttgcttgtctgtaaagtattttatttctccttcacttatgaagcttagtttggctagatatgaaattctgggttgaaaattcttttcttgaataatgttgaatattggcccttactctcttctggcttgtagagtgtctgctgagagatccgctgttagtctgatgggcttccctttgagggtaatccgacctttctctctggctgcccttaacattttttccttcatttcaactttggtgaatctgacaattatgtgtcttggagttgctcttctcgaggagtatctttgtggtgatctctgtatttcctgaatgtgaatgttggcctgccttgctagattggggaagttctcctggataatatcctgcagagtgttttccaacttggttccattctccccgtcactttcaggtacaccaatcagacgtagatttggtcttttcacatagtcccatatttcttggaggctttgctcatttctttttattcttttttctctaaacttcccttctcacttcatttcattcatttcatcttccatcgctgataccctttcttccagttgattgcatcagctcctgaggcttctgcattcttcacatagttctcgagcttaggttttcggctccatcacctcctttaagcacttctctgtattggttattctagttatacattcttctaaaaatttttcaaagttttcaacttctttgcctttggtttgaatgtcctcccgtagctcagagtaatttgatcgtctgaagccttcttctctcagctcgtcaaagtcattctccatccagctttgttccgttgctggtgaggaactgcgttcctttggaggaggagaggtgctctgctttttagagtttccagtttttctgttctgttttttccccgtctttgtggttttatctacttttggtctttgatgatggtgatgtacagatgggtttttggtgtggatgtcctttctgtttgttagttttccttctaacagagaggaccctcagctgcaggtctgttggagtaccctaccatgtgaggtgtcagtgtgccctgctggggggtggctctcagttaggctgctcgggggtcaggggtcagggacccacttgaggaggcagtctgcctgttctcacatctccagctgcatgctgggagaaccactgctctcttcaaagctgtcagacggggacatttaagtctgcagaggttactgctgtctttttgtctgtctgtgccctgcccccagagatggagcctacagaggcaggcaggcctccttgagctgtggtgggctccacccagttcgagcttcctggctgctttgtttacctacgcaagcctgggcaatggtgggtgcccttcccccagcctcactgccaccttgcagtttgatctcagactgctgtgctagcaatcagcgagactctgtgggcgtaggaccctctgagccaggtgcgggatataatctcgtggtgcgccgttttttaagtccatgggaaaagcacagtattcgggtgggagtgacctgattttccaggtgccatccatcacccctttctttgactcagaaagggaactccctgaccccttgtgcttcccaagtgaggccatgcctcaccctgcttcggctcgtgcatggtgtgtgcacccactgacctgtgcccactgtctggcactccctagtgagatgaacccggtatctcagatggaaatgcagaaattacccgttttctgcgtcgctcatgctgggagctgtagaccggaggtgttcctatttggccatcttggctccttggatccacattttgtttatccaatctactgttgatgggtacttggtttgattttccatggctttgctattgtgaatagcacagtaataaacatatgagcacaagtaggttttggtataataacttattttcttttgggtatattcccagtaatgggattcctgggtctaatggtctctctgttttaaattatttgagatgtctcaaaactgcctttcccaccaacagtgcataaacattcccttttctccacagccccaccagcatctgttgttttttgagtttttggtaatagccatactgactggtgtgtgatggtatttattgtggttttgatttggatttgtcttatgattactgatgctgagcagttttttatatatttttggccacttgtatgtgctttatgatgttatgattcttttgtttccatgtttagaattcttttgagcatttcttgtagggttggtgtagtggtgacacattcacttaacatttgcctgactttgaaatactttatctctccttcatttggcaggatataaaatttggggctggcatttttgctttaagaaggcttaaataggtctttaatttactggtctgtagactgtctgctgagaaatctgctgttagtccaatgggatttactttatagatgatttgatgcttttctctacgtgctcttaagatttttttcatgttgactttggataggcagatgactgcatgccttggtgatgttcaccttgtaaagtatcttctagttattctctgagcatcttgcatttgcatgcctacatctttatcaagaccatgaaaactttcctaaagtgtctcctcaaatacgttttccaagcctttaacattttctccctcaggcatgcttataactggtgggtttggtcactttacgtaatcccatattttccaaaggctttgttcatttttgaaaattcttctcttatttttatgtgagtaggtgaatttgaaagaccactctttatgttctaaaattgtttcttgtgcttgatcctaggacagtgtgaaaacctttgactgtatttaacttttcattttcagaatttctgctttttcaaatttgtctttccttttacattttaaactgtttttggtgttttgattttttttaaaattttaacttttattttaaattcaggggtacatgtgcaggatgtgcaggtttgttatatagataaacatataccatgttggtttgctgcacagatcatcccaccactcaggtattaagcccagaatccattagctatttttcctaatcctctccctttttccaccccctgccctcctacaggttccagtgtgtccccctgcccaatgtgtttccatgtgttctcataatctatctcccacttagaagtgagaacatgcagtatttggttttctgttcccacattagattgctaaggacactcacctccagttccatccatgtctctgcaaaggacatgatctctttccttttatggctgcatagtatgccatggtgcatacttaacatattttcttcatttaatctgtcattgatgggcgtatatgtttcttccacacctttgctattgtgaatagtgcttcaatgaacgtgtgcgtgcatgtgtttttataatagaacaatttatattcctttgggtatatacccagtaatgggattgctggtttgaatggtatttttgcctctagacctttgaggaatccccacactgtcttttaaaatggttgaactaattcatactcccactatcagtggaaaatcatgcctttttcttcacaacctcaccagcatctgttgtttttttgacttttaaatcatagccattctgactggtgtgagattgtatctcactgtggttttgatttgcatttctctaataattagtgattttttttcatatgtttgttggccacatgtatgttttctttttttttttttttttttttttgagacggagtcttgctctgtcgcccaggctggagtgcagtgacgcaatctcggctcactgcaagctccgcctcccaggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtatgttttcttttgagaagtgtctttgcccacttttgaatggggttgtatggtttttttctgataaatttgtttaagtttcttatagatcctggatattagacctttgtcagatgggtagattgcaaaattttttttcccattctgtaggtttcctgtttactctgttgatagtttcttttgttgtgcagaagctctttagtttaattagatcctatttttcaattttgcttttgttgcaattgcttttttgtcttcatcctgaagtctttgctcatgcctatttcctgaatgatattgcctaggttttcttctggagtttttacagtgtttggtttttcatttaagtctttaatattgagttgaatttgtatatggtggaaggaaatattacagtttcaattatctgcatatggctagccagttctcctagcactatttgttaaatagggaattctttccccattgcgcattcttgttaagtttgtcaaagatcagatggtggtaggtgtgtggtcttatttctgggttctttattctgttcttttggtctatgtgtctgttcttgtactagtaccatgctattttggttactgtagctctgtagtacagtttgcattcaggtagtttgatgcctcgagctcttttttttttttttctttttacttgggattgccttggttattcaggctcttttttggtttcatattaattttaaaatagttttttctaattctgtgaagaatgtcagtagtagtttaatgggaatagcattgaatctgtaaattgctttgggcagcatattagtctgtttacacactgccatatagaactacctgagacatagtaatttataaaaaaagaggtttaattgattcacagttatgcatggctggggaggccttaggagacttatgattatggcagaagctgaaggggaagcgaggcacatcttatctagtggcaggaggtagatagcaagggggagactggccatacacttttaaaccattagaccttgttagaactcactatcatgagaacagcatgggaaaaaccactctcatgatccagttacttcctactaggtccctttcttggcatgtgggaattacaactggacatgagatttgggtggggacatagagccaaaccttattatttaactcctggattctcctaaatctcatgtccttctcatgttttgaaaccaatcacaccttccaaacagtcccccagcctcttaatttattccaacattaactcaaacgttcaagcccaaagtctcatgtgacactatgcaagttcctatcacctatgagcctgtaaaataaaaaaaatttagtgatttcttagatacaatgggagtacaagcattgggtaaatgctcccattccaaatgcaagaaattggccaaaacaaagaagttacaggccccatgcaatccagaacccagcagggcagtcattaaatcttaaaactccaaaataatctccttcaactccatgtctcacatgcaggccacactgacacaatgcatggccttctaaggccttgggcagatcctccccagtgattccacagggtagagcccctgtggctgctttcttgggctagcattgagtgcctgtggcttttccaggtgcatggtgcaagctctcagtggatctatcatcctaggttctggagcatggtggccctcttctcatggctccaccaggcagtgccccagtgggcactctgtgtggggccttcaaccccacatttcccctctgcactgccctagtagaggttctccatgacggctttgcccctgcagcagacttctgcctggacatccaggcgtttccatacatcctctgaaatctaggcataggctcccaaactgttgccttctgtgcacccacaggctcaacagcatgtagaagccaccaagacttgggacttgcatcctctgaaactactgtctgagctgtaccttggcctcttttagtcacagctggagctggagcagctgggacacagggcaccatatcccaaagctgcacagaccagcaaggtcctcggcccagcccacaaaagtatttttctctcctaagccttcaggcctttgatgggagtggctgccataaagatctttgaaatgccctggagacattttccccattttcttggttattaacattcaccttctctttacttatggaaatttctacaggcagcagcttgaatatttccccagaaaatccatttttgttttctaacacatggtcaggttgcaagttttccaaacttttatgctgttttcctttaaaacataagttccaatttcagaccatccctgtgaacacacatgactgtacacattcagaaacagccaggtaatgtcttgaatgatttgctgagctgcttagaaatttcttcttcaatgggcaccatggatcatgcctgtaatttcagcactttgggaggccaaggtggggatgacttgaggtcaggaatttgagaacagtctggtcaacatggtgaaaccccatctttacaaatcatacaaaaattagctgggtgtggtttcatgtgcctgtatttccagctactcaggaggctgagacatgagaattgcttgaatccaggaagcagaggttgcagtgggccatgatcacaccactgtactctagcctgggtgacagagcagaactctctcagaaaaaaaatttgttctgcaagataccctaaatcatctctctgaagttcaaagttccacagttctctagtttaggggcaaaatgctgccagtctctttgcttaagcatagcaagagtgacctttactttacatcccaataagctcctcacttccatctgagttcacctcagcctggacttcattgtccatatcactatcagtattttggtcaaatccattcaaaagtttgtaggaagtcccaaactttccccaatattcctgtcttcttttgagccttccaaactgctccaacctctgctcattacccagtttctatgttgcttccacatgttcaggtacctttatagcagtgccttactcccagtatcacttttttgtattagtctgctttcacacagctataaagaactacctgagcctgggtaattcataaagaaaagatgttttgttgactcgcagtgacacacatctggggaagcctcaagaaatgtacaatcgtggcagaaggtgaagagaagcaaggcacattttacacagtggcaagagagtgaggggggaactgccacacacgtttagtccatcagatctcatgagaactcagtatcatgcaaacagcatgcgggggtgcgggttgctcccatgataaaattaccttgcaccaagttccaatctccatgtagggattacaattcgatttgagatttgggcatgaacatagagccaaaccatatcaggtagtatggccattttgatgatattgattctttatccatgagcatgaaatgtttttccactcgtttgtgtcctctctggttttcttgagtagtgttttgtagttcctgaagaggttcttcacttttcttgttagctgtattcttaggtattttcttgtgtggcagttgtgaaggagaattcatttactatttggctcttggcttgcctcttggtgtataggaatgctggtgatttttgtacattgattttgagttctgagactctgctgaagtggcttttcagtttcttctgtgaagttattgggctgatatgatggggttctgttgaaataggaatagaatcatgtcatctgcaaacaaagatagtttgacttcttctctttttatttgaatatgcttaatttctttcttttgcttgattgccctggccagaacttccaatactgtgttgaataggagtggtgagagagggaaactttctcttatgccaattttcaagggaaatgcttcttctttttcttcttcttcttcttcttcttcttcttcttcttcttcttcttcttcttcttcttcttcttcttcttcttcttcttcttttttttgagacagagatttgttcttgttgcccaggctggagtacaatggtgctatctcagctcactgaaacctctgcctccagggttcaggagattctcctgcctcagcatcctggtgttttgggtagctgggattacaggcatgaggcaccatgcctggctaattttgtatttttagtacagatggggtttctccatgttggtcaggctggtctcaaactcttgacctcaggtgatccacccacctcggcctcccaaaatgctgggattacaggcccgagccactgcacctggccctcaaggcgtcaagatagaataagcttctatcttttgcttattcaacatgatatttgctgtgtgtttgtcatatatggcttttattattttgaggtttgttctttcaatacctgtttattgagagtttttaaaatgaaaggatgttgaattttgtcaatggcattttatgcccctattgagataatcatgtggttttgtctctagttctgtttatgtgatgaatcacatttgatttgcatgtgttgagccagccttgcatcctgggaataacttctgcctgattatgtgttgcgggaagtcagggaccccaaacagagagactggctgaagccatggcagaagaacataaattgtgaatatttcatggacattgattagttcctcaaattaatacttttataatttcttacacctgtctttactgcaatctctgaacataaattgtgaagatttcatggacatttatcccttccccaatccatactcttgtgatttcctatgcctgtctttactttaatctcttaatcctgacatctttgtaagctgagtatgaatgatgcctcaggatcctgtgatgattgcgttaactgcacaaattgtttgtagagcacgtgtatttgaatgatatgaaatctgtgcaccttaagaacaggataaccacgattttcagggaacaagggagatgaccttaaagtctggctgcctgtgggcaggaaggacagagccatatttctcttactaccaaaaatgggtaagataaatgtcactgaactctttccccagtaaggaatattaataattaacagccctgggaaaagaatgcattcacagaggaggcctctgaagtggccgctctgggggtgtctgctttatgcagatgtagatagggatgaaacatgccctcgtctcctgcagtgcccccaggcttgctaggattaggaaattccagcctggtgaattctagtcagaccagttctctgctcttgaagcctgacaatgcgtgcacagtgggacatagaagttcattagtgattctagtttcaccctgaccttctgccttgtgatcttttgttgcccttgaagcatgtgatctctgtgacccacaccctatttgtgcactccctcccctttgaaaattcctaataaaaacttgctggttttacagctcaggggcatcatggaacctaccgacatgtgatgtctccctgggcccccagctttaaaatttctccttttgtactctgtccctttatttctcagactggctgacaattagggaaaatagaatagaacctacatgaaatattgggggtgaattttgcccaataattatggtggataggctttttgctgtggtggataagctttttgctgtgctgatggattcagtttgccagtattttgttggggatttttgcattgatgttcatcaagaatattggactgaagttttcttttcttgctatatctctgccagggtttggtatgttggcctcatagaatgagttatggaggagtccctcctttttaatgttttggaatagtttcagtaggaatggtaccagctcttctttgtacctctggtagtattaagctgtgaattcgtctgttcctgggctttgtttttggtttgtagagtattttttactgtctcaagttcataactcattattggtctattcaggattcagtttctccgtgcttcagtcttcagagcatgtatgtgtccagcattttatccatttcttctcaattttctagtttatgtgcatagaggtttttgtagtattctctgatatttgtatttctttggggtcagtggtgatacacttcttattatttctggttttgtctacttgaatttttctctcttttcttcattagtctagctagtagtctctattttaataatttttttcaaaaagccaacttctggatatgctgatttttgttaagggtttttcgtgtctctatctctttctgttctgccctgatcttgactacttcttgccttctgctagctgaggggtttgtttgctcttggttctctagttattttagttgttatttatgttattaacttgagatctttctagctgtttgatatgggcattttagtgctacaactttccctcttaacactgctttagctgcatcaaggagattcccagatgtgttgtatattctcattagtttgaaagaacttcttgatttctgccttaagtttattatttactcattcagaagcaggtggttcaacttccatgtagttatatggttttgcatgtatttcttaatcttgagttctaatttgattgtgctgttctctgagagactgtttattattatttcagttcttttgcatttgctgaggagtgttttactttcaattatatggtcaattttatactaagtgccaagtggtgatgagaaggatgtatattctgttgtttgggtgtggtgagttctgtacctatcaggttcacttgattcagagctgagttcaggccctgaatatgtttcttaattttctgtcttgatgatctgtctaatattgtcagtggggtgttaaagtctctcactattattgcctgggagtctaagtctgtttgtaggtctctaagaacttgttttatgaatctgggtgctcttgtactgggttcatagatattccagatagttagctcttcttgttgaattgagccctttaccattatgtgatgcccttctctgccttttggatctttgtttgtttaaagtctgttttttcagaaactaggattgcaacacctgctttttgtttggtaaattttcctccatccctttattttgagcttatgtgtgtctttgcacatgggatgggtctctggaaggcagcataccatttgttcttggttttttatacagcttgctattctgtgtcttttaattggggcatttagcccatttacatttaaggttagaattattatttgtggatttgatcctgtcatcatgatcctgcctggttattttgtagacctgtttatgtggtctacagtgtcacttcatagtgacactggtctgtgtacttcagtgtgtttttatagtggctggtaatggtttttcctttccatattcagtgctttcttcaggagctcttgtaagtcaggtctgctggtaacgaattacctcagcattagtttgtttgaaaaggatcttatatcttctttgcttataaagcttagtttggccagatatgaaattctgggttggaaattcttttaagagtgctgaatagtggccttcaatctattctggcctttaaggtttctgctgagaggtccactatttgtctgctgggcttccctctgtaggcgatgtggcctttctctctggctgccctgagcattttttccttcatgtggaccttggagaatctgctgattatgtgtcttgaggacgatttttttttgtggattatcttactggggttctctgcatttttgaaatttgaatgttggcctgtctaggtagatcagggaagttctcctcgatggtatcccgaaatgttttccaaattggttttactctcctcatctctttcatgtacctcagtcagttgtagattcagtctctacataaccccatatttctgtgaagttttgttcattcctttgttctttgtttttattcttgcctgcctgtcttatttcagaaggtcagtcttcaagctctgagattcttccctttgtatggtgtattctgctactagtacttgtgattgcattatggagtttgttagtgtgtttttccgctctatcaggtcagttatgtttctctctatgctggctatcagctcttgcattattttatcaagattcctagcttccttacaaggggttgcaagtggcttttttagctcagtgcagttcatttttacccacattggaagcctacttgtgtcatttcagctatttctagcctcagtccagttctgaatccttgctggagaggtggtgttgtggccatttggagaaaagggggcactctgggtttttgaatttttattatttttgcactgattctttctcatctttgtggacttatctacctttgatctttgaggttcctgatcttaggttttttttttttttttttggatgtttatttgcttgggtgcttttctttcagcagtctggccactgtttcataggggtgctgcagtttgttggggttccattctagacccttgttgcctcagtttttccagtacctggaagtatcaccagagaaggctgtgaaacagcaaagatggcatcctgctccttcctctggtagcttcattccagggggcctgaatgcacctataggagttggctggagacctgggttggaatacctcacccagtcagagggaaagggatcggagacaaacttgaagacgcagtctggctgaattttgtagagcagctgtgctgtattggggatcccttcagcctcccagttggtttggatcctttaaggttcacaggttggaccagctcagatgcccaaataggaaaggtggtggcctgcttcacccatcaggcactccatcccagggataaattagaactttgtttgcaatagaacatgagcagtggtgaccagaggctttggctgggagagccagcaaggaggaatggatctgagtcctgttgaaagaagcagtctggccacttctcaacaaaacagctatatcatgctgtggaattgctttttgccttgtctgcttatactctccaaagcccacaggcttgaagggctgagtcatccaaacagcaaagatgatgacccacccctccccacaagcactttttggcagaaagatatcagaacgctgtccatagtatacaggtgagggtggccagaggccttggctaggaggactgaccttgtgagaaggagtagatcagggacccatttaaagaagcagtctggccatgcctcaacaaaacagtcatgacaggctgtggaaccacctttgccctgttggtgttggactctccctaggcctaaggctggaatggctgagttgtccaaacaaccaaggtggcagcccatcccaaggagagatcagaactctgtctatagaatatgagtgggagggggtggctggagacccaagttgggaggtctcacccagtgaggaagaatggattgaggtttcacttaagcagtctggccacgttctggcaaagcagctgtgctgcactgtgaggaccttttctcatttgtaccatctggactctccaaatcctgctggctggaacagctgggttgaccaaacagcaaagatgatagtgtgccccttgtcttgggggttccatcccatctcaggcaggctccaccctgtttttagtggctggctggaattccaagccaatgggtcttatcttgtgacatgccatggaagtggggcccgcagactgctgctgctcagctccttcaattctgcccccttcctatgggtatgtacggacctttgaccttgcctgagttgcagtcacctttgtcagggatcctgggctcagagtctataaagctcctgggtttctgtgcatgcctgagcagttgctctgccaagactccacacagctgtgtgttggacccaaggcccctgtagtgtgggctcacaaggtaatctgctgattggagggttgcaaagatctgggggagaagtgtggtttccctggggttgcacattgactcactgcttttcttggctgggggtgaggggctccctttccaaattgttaatctgatttctttgtggtggttttcaactctcttgtatctcattgggctttcttacaagccatagtttgccatttgtggaattggtggaatttgtcctttcagaatttttattttgtttaggacccatgtctagaccgctagtgtgatccttatgggtgctgcaacactctgttttttgtgatgccacagttcttattctgattttttttgaatttacttctgttcagatggggattttaccccccgagggtttatttcatatgttgagtagcattttttttggctttgcttctttatgctattagggggcaaagctttgtttgaattccttggtagtagatagcctttgtgtagtggtgttctcaaatgccggttgtttgtagcatgtagtagtggtgtactatgcatgtgagtaggcttgctgtcttctgcagagatgggtaggaggctcatcattttttacagcagtgtgaacttctgtcagcaggaattattttaaattctgccgtccatcctatagaccagtaggtggcacttgtaagagctagctgaatgctgcacagatgtgtcagcataagctgtaatcatttttgcagactggcatcaaagtcagtaggttgtacttgcaagaaagaggcagcttcagtggtggcagtgagatttttacttggccatttaaaaccaggagaagtgccagggtatctcagtgatgggcagggctgtggagctcctggggatccctgtccggttctttgctaccaaggtgactagagtgggcaatgctggtcatggctgggttggtatgtcagtgagcaggctcttgaaggcaggcataagtaccaacgtttgcagcagtctaggcacagctcccaggctgctggagcaactcttaagggaggaatagaggtgtctgtccaccacagagcctactgaggtgaagaagggcatggcccagagtgttcagcatagtaggtggctgtgggatccacctaattcccacacccctgacctgaaagttctccctccaggcgctagctgctgccagaatgccagaatgcttagactggtcccaaagagtctacattcagattgttgaacagttccagaaactgtagctatgaggccacaccctctcaggactagtcttgtgatgaaaggcgggcccagctcctatgccacagcatacattcacacaacagtcttctctgtgttctgtcagtgggaattcctcccctgttggaggtcacataacaaatctcatcttcatgcacctgagtgattgtgttgagtcctggggaactgggataaggtcagtaggtttttcccctggccactcaggctgtagcacctgctgtgatcagaaggggtaaacagcttccaggccaccaaaagaacactcaggtgtggcaacagcaactgtgccacatatctcaacttcctgtgagaatgggaaggcaggcagtcttgggatgaactggcaggcatgggatgtgtggcttgaatgtacttcattcccaacacaatggtggtggaacctgtttagggagcaagagagtgccttgggccccactcattccctggcctgacaggcaacagcagcatcacctcaaaataggatgcaaagccttcagggatgggcaccaaaattgtgctttgctacagcagcccagcacatggaagtccttcatgttttgtttaaatgcatacatttgtttgagggatggagaaggtgtacttatatacctcagcatgtttcatttttctttttatcatgcaaggagttgatttggttcaggcaaatattcattgaagtttaaaatgtacatacctcaccatgcagtaaacacctgtttaatgtctgacctgctcagatttcatttacttgtactgataatgcttttttgttttatttattcataacattttacatatttatcaggtacttgtgattgttacatgcatagaatgtattatcaagccaggagtatttgaggtatccatcaacttgagtgtttgtcatttttgtgttggtaccatttcaagtcttctagctactttgaaatatactctgctatctgaagtcacccaactctgctatcaaacattagaatttatttcttctaactgtatgtttgtatccattaaccagcctctcttcatcctcccttctaccctcacatcttcccagcctcaggtagttatcattctctgtcttcatgagatcaacttttttagctcctccaaatgagtgagaacatacaagatttgtctttctctgcctggcatgtttcacttagcatggtaacctccaggtacatccatgtcattgtaaatgacatcttatttcttcaattactgaataataatccataatgcatatataccacattttctttatctgttttattgatacttctgttgatttcatagctttgctgttgtgaagagtgctataaacaattgagtgctggtatctcttggatatactgttttcttctcttatggataaataccccatagtgggattgctagattgtatgatagttctacttatagcttttaaataaatgtttacgctgtttttcatagtagttgtactaatttacattcccacaaactgtgtaataagcattccctttatccgcatccttgccagtatctgtttttgtttgttgttgtttttgcttgttttgtctttctaatcattttagctggggtaagatgatgtctcattgtggtttcaatttgcatttccctgatgattagtgatgttgagcgttttctatgtaactattggtcattagtatgttttcttttgataattatttatttatttatttattacttttgattatgaatcctcctggaacttgattctttaaaaatttattattattatactttaagttttagggtacatgtacacaatgtgcaggttagttacatatgcatacatgtgtcatgctggtgcactgcacccactaactcgtcatctagcattaggtatatctcccaatgcttcccctccccactccccccaccccacaacagtccccagagtgtgatgttccccttcctgtgtccatgtgttctcattgttcaattcccacctatgagtgagaatatgtggtgtttggttttttgttcttgcgatagtttactgagaatgatgttttccaatttcatccatgtccctacaaaggacatgaattcatccttttttatggctgcatagtattccatggtgtattgtgccacattttcctaatccagtctatcattgttggacatttgggttgcttccaagtctttgctattgtgaataatgccgcaataaacatacgtgtgcatgtgtctttatagcagcatgatttatagtcctttgggtacatacccagtaatgggatggctgggtcaaatggtatttctagttctagatacctaaggaatcaccacactggcttccataagggttgaactagtttacagtcccaccaacggtgtaaaagtgttcctatttctccacatcctctccagcacctgttgtttcctgactttttaatgattgccattctaactggtgtgagatggtatctcattgtggttttgatttgcatttctctgaaggccagtgatggtgagcattttttcatgtgttttttggctgcataaatgtcttcttttgagaagtgtctgttcatgtccttcacccactttttgatggggttgtttgttttttttcttgtaaacttgtttgagttcattgtagattctggatattagccctttgtcagatgagtaggttgtgacaattttctcccattttgtaagttgcctgttcactctgatggtagtttcttttgctgtgcagaagctctttagtttaattagatcccatttgtcaattttggcttttgttgccattgcttttggtgttttagacatgaagtccttgcctatgcctatgtcctgaatggtaatgtctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccctattgcttgtttttgtcaggtttgtcaaagatcagatagttgtagatatgcagtgttatttctgagggctctgttctgttccattgatctatatctctgttttactaccagtaccatgctgttttggttactgtagccttgtagtatagtttgaagtcaggtagtgtgatgcctccagctttgttcttttggcttaggattgacttggagatgtgggcttttttttggtttcatatgaactttaaagtagtttttttccaattctgtgaagaaagtcattggtagcttgatggggatggcattgaatctgtaaattaccttgggcagtatggccattttcatgatattgattcttcctacccatgagcatggaatgttcttccatttgtttgtatcctcttttacttccttgagcagtggtttgtagatctccctgaagaggtccttcacatcccttgtaagttggattcctaggtattttattctctttgaagcaattgtgaatgggagttcactcatgatttggctgtcggtctgtctgttgttggtgtataagaatgcttgtgatttctgtacattgattttgtatcctgagactttgctgaagttgcttatcagcttaaggagattttgagctgagacaatggggttttctagatatacaatcatgtcgtctgcaaacagggacaatttgacttcctcttttcctaattgaataccctttatttccttttcctgcctaattgccctggccagaacttccaacactatgttgaataggagtagtgagagagggcattcgtgtcttctaccagttttcaaagggaatgcttccagtttttgcacattcagtatgatatcggctgtgggtttgtcatagacagctcttattattttgagatacgtcctatcaatacctaatttattgagagtttttagcatgaagtgttgttgaattttgtcaaaggccttttctgcatctattgagataatcatgtggtttttgtctttggttctctttatatgctggattacatttactcatttgcgtgtattgaaccagtcttgcatcccagggatgaagcccacttgatcatggtggataagcttttggatgtgctgctggatttggtttgccagtattttagtgaggttttttacatcaatattcatcaaggatattggtctaaaattctcttttttggttgtgtctccacctggctttggtatcaggatgatgctggcctcatgaaatgagttagggagggttccctctttttctattgattggaatagtttcagaaggaatggtaccagttcctccgtgtacctctggtagaatttggctgtgaatccatctggtcctggactctttttggttggtaagctattgattattgccataatttcagctcctgttattggtctattcagagattcgacttcttcctggtttagtcttgggagagtgtatgtgtcgaggaatttatccatttcttctagattttctagtttatttgcgtagaggtgtttgtagtattctctgatggtagtttgtatttctgtgggatcggtgttgatatcccctttatcattttttattgcgtctatttgattcttctctgttttcttctttattagtcttgctagaggtctatcaattttgttgatcctttcaaaaaaccagctcctggattcattaatttttggaagggttttttgtgcctctatttccttcagttctgctctgattttagttatttcttgccttctgctagcttttgaaagtgtttgctcttgcttttctagttcttttaattgtgatgttagggtgtcaattttggatctttcctgctttctcttgtgggcatttagtgctttaaatttccctctatacactgctttgaatgggtcccggagattctggtatgttgtgtctttgttctcgttggtttcaaagaacatctttatttctgcctttatttcgttatgtacccagcagtcattcaggagcaggttgttcagtttccatgtagttgagtggttttgagtgagattcttaatcctgagttctagtttgactgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggggagttctgtagatgtctattaggtccgcttggtgcagagctgagttcaattcctgggtatccttgttgactttctgtctcattgatctgtctaatgttgacagtggggtgttaaagtctcccattattaatgtgtgggagtctaagtgtctttctatgtcactcaggacttgcttttcgaatctgggtgctccagtattgggtgcatatatatttagcatagttagctcttcttgttgaatggatccctttaccattatgtaatggccttctttgtctcttttgatctttgttggtttaaagtctgttttatctgagactaggattgccacccctgcctttttttgttttccgtttgcttggtagatctacctccatccttttattttgagcctatgtgtgtctccgcacgtgagatgggtttcctgaatacagcacactgatggttcttgactccttatccaattttccagtctgtgtcttttagttggagcatttagtccatttacatttaaaattaatattgttatgtgtgaatttgatcctgtcattatgatgttagctggttattttgctcgttatttggtgcagtttcttcctagtctcgatggtctttacattttggcatgattttgcagtggcatgtaccggttgttcctttccatgttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcctccactctcttctggcttgtagagtttctgccgagagatccgctgttagtctgatgggcttccctttgtgggtaacccgacctttctctttggctgcccttaacattttttccttcatttcaactttggtgaatctgacaattatgtgtcttggagttgctcttctcgaggagtatctttgtggtgatctctgtatttcctgaatgtgaatgttggccttccttgctagattggggaagttctcctggataatatccttcagagtgttttccaacttggttccattctccctgtcactttcaggtacaccaatcagacgtagatttggtcttttcacatagtcccatatttcttgaaggctttgctcgtttctttttattcttttttctctaaacttcccttctcgcttcatttcattcatttcatcttccattactgatatcctttcttccagttgatcacatcggctcctgaggcttctgcattcttcacgtagttctcaagccttggttttcagctccatcagctcctttaaggccttctctgtattggttattctagttatacattcttctaaacttttttcaaagttttcaacttctttgcctttggtttgaatttcctcccgtagctcagagtaatttgatcatctgaagccttcttctctcagctcgtcaaagtcattctgcttccagctttgttccgttgctggtgaggaactgcgttcctttggaggaggagaggcgctctgctttttagagtttccagtttttctgctctattttttctccatctttgtggttttatctacttttggtctttgatgatggtgatgtacagatgggtttttggtgtggatgtcctttctgtttgttagttttcctctaacagagaggaccctcagctgcaggtctgttgaagtatccggccatgtgaggtgtcagtctgcccctgctggggggtgcctcccagttaggctgctcggggttctggggtcagggacccacttgaggaggcagtctgcccattctcagatctccagctgcatgctgcgaggaccactgctctcttcaaagctgtcagatagggacatttaattctgcagaggttactgctgtcttttcgtttgtctgtgccctgcccccagaggtcgataattatttattaatgtccttagcccacttttagataggattttttaaaattgttgagttccttgtatattctggatattagtgccttatttgatgaatagttttaaaatattttcttccattcaacaggctgtctcttccatctattgattgtttcttttgctgtgctgtgattgtttcttttcggtttctttgtatcatctataatttctttcatcaatgttttacagtgttttcttgtagagatctttcacgtccttcattaaatatagtcctcggtattttatgttttgtttctattgtaaagaggattgagttattgacttggttttcagtttgaccattattggtgtatagaaatggtactgattttttgtatttttgtatgttaattttgctgtatcttgtaactttactgaatttgctctcagctcttagagggttctttttggtgaagttctttggtttttctaaatataagtttatgtcatctgcaaagagggatgagaaaggtttaattgaaaaagcttatccccatcttggaaatttatggagccattaacggtgggctttttgcagctgtgacatgttagctacaactctcattggaaaatgggaaaggcttttctgacccataagggctgtctgatacatgaagataaaaacctaatgtttggccactttgttgttgtttcttgttctgttgttaattttagggaatttatttatttatttatttatttagtgtgtgttatagcagtgatttattttattattattattattattattaatattattattttttatttttttattgatcattcttgggtgtctctcccagagggggatttggcagggtcataggacaatagtggagggaaggtcagcagataaacaagtgaacaaaggtctctggttttcctaggcagtggaccctgtggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacgggatcccaaggcagaagaatttttcttagtacagaacaaaatgaaaagtctcccatgtctacttctttctacacagacacggcaaccatccgatttctcaatcttttccccacctttcccccctttccactccacaaaaccgccattgtcatcatggcccattctcaatgagctgttgggtacacctcccagacggggtggtggccaggcagaggggctcctcacttcccaggagggacggccgggcagaggtgcccctcacctcccagacggggcggctggccgggtggggggctgacccccccacctccctcccggacggggcagctggccgggcggggggctgacccccccacctccctcccggacggggtggctggccgggcagaggggctcctcacttcccagtagggacggccaggcagaggcgaccctcgcctcccggatggggcagctggccgggtgggggctgacccccccacctccctcccggatggggcggctggctgggtgggggggctgaccccccacctccctcccggacggggtggctggccgagcgtggggctgaccccccccacctccctcccggacagggcggctggctgggcggggggctgacccccccacctcactcccagattgggcggctgccgggcagggtgctgacccccccacctccctcccggacggggcggctggccgggtggggggctgacccccacctccctcccggacggggtggctgcagggtggagatgctcctcacttcccagaaggggtggctgccgggcggaggggctcctcacttcttagatggggcagttgccaggcagtgggtctcctcacttctcagacggggcagctgggcagagatgctcctcacctcccagatggggtcacggccgggcagaggcgctcctcacatcccagatggggcggcggggcagaggcgctccccacatctcagacgatgggcggccggacagagatgctcctcacttcctagatgggatggcggccaagcagagacgctcctcacttcccagactgggcagccaggcagaggggctcctcacatcccagacgatgggcagccaggcagagacactcctcacttcccggacggggtggcggccgggcagaggctggactctcagcactttgggaggccaaggcaggctgctgggaggtggaggttgtagcgagctgagaccacgccactgcactccagcctgagcaccattgagcactgagtgaaccagactccgtctgcaatccctgcacctcgggaggccgaggctggcggatcactcgtggttaggagatggcgaccagcccggccaacacagcgaatccccgtctccaccaaaaaaatacgaaaaccagtcaggcgtggtggtgggcgcctgcaattgcaggcacttggcaggctgaggcaggagaatcaggcaaggaggttgcagtgagctgagatggcagcagtacagtccagcttcagctcggcatcagagggagaccgtggaaagagagggagagggagactgtggggagagggagagggagagggagagggagagcaattttagggaatttattaagcttcataaatttatgggataaatggaggcccctaggttaggggtgatgccactgtgagattcagagtcacttcagtgtaaggaggctgcagcagtgtttagaaagtgtgtcataattatagccatattttgacttctggaggcaagggcaggaagtgtggcttttccctgacatacagttgccaggtaggcagttatttggttgcataaataattgtaattttatggaaaaattttggagattgaaaatagaaattaaaattactccaccattcaaaagcaattgttattaccatgtttgtataatttactttagagtttaaaattttcatgtatatatatttttaacttacaatgtagattaaataaatagagatgaggttttgccacattgcccaggctggtcttgaactcctgggctgaagctatcctcccacctcagcctcccaaattgctaggattaaagacatgatttattgtgcctggcctcatgtatattatggaaactgttaagattattttacatgagagctttatatttgcttaaggtttgaaaggcttcagagtttatgtaggaagttacagacaatgtttctgttcatgtatcaaaagaaaaataatattcagagactgaagtttttctagggcagtgccacaagggttcatgtccttagaagttagcagtggcctatctaggacagtgtaattgtggtgattgttttttgttttgttttccctattatctcttatccctggaaaacatctttcagcattaggcaatgtgctatttgacattgatcagtcccttaatttatggccacttttcctgcaggtttttatgcagccagtgttaaacagctgctggtcttaagctaaaggtgggaaggtcatggcacgcagtgtgggctggatttagaatatgaattgctacagttttattttgaagaacatagagcatcagtagatgatgggcatttagggcctccataaagactgcagctgaggaaaagattcacttataagtacaggagcatcatgttgggaggggtcaagttaattattgaccacagcttttacaatctgctttatcaaccagggctgcaggctgggaacttagtacagctaaattttatgtataaagaactagtgtgtaagtgggatttatgttatgtgtgcagaggtaggctggcactcactttttgcactatttttggctgaattaagggcctaaagatgggctaattcatggatatacatggcttccacataggcttttaaaagccactccccactctgtagtttcaagttggccatggatttgttaatcaaagtcaactgtgatcttagtactagaccattctgagacatacaatgcacccttgtccacagaagggtggtagaattttattaacaatcttgcaaaaagacatgagacttattattaaaaatggtccctttttgggttgaagtagaaaaacacctcagtgaagccattaccacaccaaagtctagaaagccggtgcctggaggactacatctcaagaatcagctttgctgaggaagccagagatgagtttgaagagtatgcttcaacccttctataagaacaagtgcaacagaatattgagaataacagaataagacatttaggaatatttaactgaaggaagcaaaggatttccttatgagaaaggttgaggttttattggttaaaatcaacagatgtgaaggggaagcaagaactgtaaggacagacaaatgtagatggtctacctgttctcagaaggttttagaaaatgcgttgtgctttcattgttgctatatcagaaagaaagaccggagcctgacaaaatttagagaggaagcaaggcaggatctcataaagtagagtgatccctgagagggtgtgcccaaatgctgcagactctctcataagtgttaggagaaaccaattctccaagcatatattgggacaacagtatgacttgatccagaatgttaggacaaatttgagggggaaaggtggggcagaacagagaaaaactcaaaacataggaggtgacttaactattatgtactgtattaaaagtattatatgctgttccttgaagaaacatccccaagcaatttttggttaggactcaaggtaaagcacagaaaagatgagttatattggagggatgtagacagaagaactataatatgtactgagcccattatagatgttgagtgatggaagggtatcttctgggatggataatcttcctaggagcctggatgtacacaaaatatgtttaaacagcagatatttttggcagacccagaacctgatgttttcatgtatctcaccatggaaaactctataaccacaatctaacagaatacactagtaaaatgtccgggcctgagagcaatgccaaagtaaaaagaaagaactcggatcttacaaacattgtgatcctacttggcagaagaaaagaaacctctgaggtaggttaatcagctaagtcttcttgaaactattagaggggaaaatgaaaacacttgaggcatatagcataaaagacatagcatacagaaatattcagagctggtagcatcctaaaccagaggaaatgtcatttcttggggagtaatcatgagggaaattttttccgtgagggtgctaggggtgcaattcaccagaaacagctttatttaaggaagttgctgaaggtgattctctagctggaacacttctagggactgagggacaggaggatcttcactgggaggcaggtttcacaggtccaaacaattctgtagtgagtgacagcagccactgtggctcaggaccaaaactaccagttcctgggatacagtgttagctacctggccagatggagtccactcttagtatagcattagaagggtactcagtggggagattgagactaaaaggctgagaaaatactgaatgggaagaacttctcagtagtacctgatgcccagtgagtggggtggggggtgatttcattgcaaattttagagattaaaaagccaggagtatctcagatgacaataattgggaaagaagataagcgaataagcctttaacccactctggtgccatagttatgataaatcccatatggtcaaatttaatctcttatgacaggtttctctcaatgtaagggttttttttttaatgtgatataatctatataacgtaaaattcactgtttaaaagtgtagaattcagtgatttccagcatattaactatgtagtgcaaccatcactattgtctcactctagagtatttctgccacccccccaaaaaaaaccctgtaccaattagcagtgagtcccaatttttcccttctctcatctcctaatgaccagaaatctgctttttgcatctacaaatttacatagtctggatagttcatgtcaattgaatcacgttatatgtagccttttgtgactggcttctttccattagcacagtgttttcaagattcatctatattgtatcacatagcaatattcatttctttttatagctgaatatgttttggatatataccacattttattcatttatgcatcagttgatgggcattacattgtttcagttttttagcaattatgcataatgctgctgtgaacttttctgtacaactctaatggatttttagggtaatgctcatataccccagacaagcatctcctgtagagatcttttacctccttgggcagatgtattcctaggtttttatttgttttattgtttgttttggctataagtgggattgcattcttgatttggttctcagcttgaatgttgatggtgtatggaaataatactgatttttatatgtagattttgtatcctgaaacttcaccacatcatttgtcaagcctaggagtcttttggagaaatcctttgggttttctatgtacagaattatatgttcagtgaagagagatagtttgacttctttttctatttggatgccttttatttctttctcttggctgattgctgtggttaggatttccagtactacattgaataggagtggtgtaagtggacattcttgtttattccagttctaagagggaatgtttctaaatttgtcttttcattatgatgtcagctgcaggtctgtcacagatggctcttaatattttgaggtatgatgcttagttcattgagggtttttattataaaggggtgagttgatcagctatttagtaaagttgaaactaatatttctttttcagatacttttgagtttctataatgacctttacaacagtatatactaggttctagaacataattatgtttgcgataacattactagcaaatgggattgctttattttctaaaacgtgtgggtgcggaaaacatgatgttcagttttgtatgttctagtaatgcatttgatccttaaaaatgaggcttctgagttgacttaggagtgaacaaacacaatttctgaggtcctgaagaaactgcagccactcctgagaaagagtcaggctgtagctgctgaaagaatgcagatatggagaaaattcatctaactgaaactgaagagaatgagaagttggagagaataagtttagaatttaagttgggatttgagacattaatttctttggattcatactgcacaacaaagacagcaggaatttttcagactttagcttttatggattttaaggttaagaatttgaattttttaaagcttttaatatttgaatttaattataattcctgggaaactattaatgagagggaaattatatttaattttggagtatcaatatgtggtgacatacgattattggactatcttacggtcattatttaatatcattgcagaagctttgaaaggatatattaggtaatatggctggatacaatttaagataggaaatagaacagaagtgaagttccagctttactgatctctcagcagaaactctacaagccagaagagagtgggggccaatattcttaaagaaaagaattttcaacccagaatttcatatccagccaaactaagcttcataagtgaaggagaaataaaatactttacagacaagcaaatggtgagagattttgtcaccaccaggcctgcccaaaagagctcctgaaggaagcaccaaacatggaatagaacaacctgtaccagccactgcaaaaacatgccaaattgtaaagaccatcaaaggctaggaagaaactgcatcaactaatgaccaaaataaacagctaacataatgacaggatcaaattcacacataacaatactaaccttaaacataaatgggctaaatgctccaattaaaagacacagactggcaaattggataaagagtcaagacccatcagtgtgctgtattcaggaaacccatctcacgtgcagagacacacataggctcaaaacaaagggatggaggaagatctaccaagcaaatggaaaacaaaaagaggcaggagttgcaatcctagtctcagataaaacagactttaaccaacaaagatcaaaagagacaaggccattacataatggtaaagggatcaattcaacaagaagagctaactatcctaaatatatatatgcacccaatacaggagcacccagattcaaaaagcaagtccttagtgacctacaaagagacttagactcccacacaataataatgggagactttaacaccctattgtcaacattagacagatcaacaagacagaaagttaacaaggatgtccaggaattgaattcagctctgcacctagcagacctaatagacatctacagaactctccaccccaaatcaacagaatatacattcttttcagcatcacactgcacctattccaaaattgaccacatagctggaagtaaagcactcctcagcaaatgtaaaagaacagaaattataacaaactgtctctcagatgacagtgcaatcaaactacaactcaggattaagaaactcactcaaaaccgctcaactacatggaaactcaacaacctactcctgaatgactactgggtacataacaaaatgaaggcagaaataaagatgttctttgaaaccaacgagaacaaagacacaacataccagaatctctgggacacatttaaagcagtgtgtagagggaaatttatagcactaaatgcccaaaagagaaagcaggaaagatctaaaattgacaccctaacatcatcattgaacgaactagagaagcaagagcaaacatattcaaaagctagcagaaggcaagaaataactaagatcagagcagaagtgaaggagttagaaacacaaaaatcccttcaaaaaatcaaggaatccaggagctggttttttgaaaagatcaaaaaaattgatagacctctagcaagactaataaagaagaaaagagagaagaatcaaatagatgcaataaaaaatgataaaggggatatcaccaccgatcccacagaaatacaaactaccatcagagaatactataaccacctgtacataaataaactagaaaatctagaagaaatggataaattcctcgatacatacaccctcccaagtctaaaccaggaagaagttgaatctctaaataggccaataacaggctatgaaattgaagcaatcattaatagcttagcaaccaaaaaaagtccaggaccagatggaatcacagccaaattccaccacagatacaagggggagctgataccattccttctgaaactattccaatcaatagaaaaagagggaatcctccctaacacattttatgaggccagcatcatcctcataccaaagcctggtagagacaaccaaaaaagagaattttagaccaatgtccctgatgaacatcaatgcaaaaatcttcaataaaattttggcaaactgaatccagcaacatatcaaaaagcttatccaccatgatcaagtgggcttcatccctgggatgcaaggctggttcagtatatgcaaatgaataaatgtaatccagcatataaacagaaccaaagacgaaaaccacgtgattatctcaatagatgcagaaaaggcctttgacaaaattcacagtgcctcatgctaaaaacctctcaataaattaggtattgatgggacataactcaaaataataagagctatttatgacaaacccatagccgatatcatactgaatgggcaaaaacttgaagcattccctttgaaaacggtcacaagacagggatgcccctctcaccactcctattcaacatagtgttggaagttctggccagggcaatcaggcagaagaaagaaataaagggtattcaattaggaaaagaggaagtcaagttttccctgtttgcagatgacatgattatatatctagaaaacgccatcatctcagcccaaaatctccttaatctgaaaagcaacttcagcaaagtctcaggatacaaaatcaatgtgcaaaaatgacaagcattcttatacaccaataacagacagacagagagccaaatcatgagtgaagtcccattcacatttgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatgaagctaccaatgactttcttcacagaattggaaaaaactactttaaagttcatatggaaccaaaaaagagcccacatcaccaagtcaatcctaagccaaaagaacaaagctggaggcatcacactacctgacttcaaactatactacaaggctacagtaaccaaaacagcatggtactggtagtaaaacagagatatagatcaatggaacagaacagagctctcagaaataacaccgcatatctacaaatatctgatctttgacaaacctgagaaaaacaagcaatggggaaaggagtccctatttaataaagggtgctgggaaaactggctagccatatgtagaaagctgaaactggatcccttccttataccttatacaaaaattaattcaggatggattgaagacttacatgttagacctaaaaccataaaaaccctagaagaaaacctaggcattaccattcaggacacaggcatgggcaaggacttcatgtctaaaacaacaaaagcaatggcaatgaaagtcaaaattgacaaatgagatctaattaaactaagagcttttgcacagcaaaagaaactaccatcagagtgaacaggcaacctacagaatgggagaaaagttttgcaatctactcatctgacaaagggctaatatccagaatctacaatgaactccaataaatttacaagaaaaaaacaaagaaccccatcaaaaagtgggtaaaggacatgaacagacacttctcaaaagaagacatttatgcagccaacagacatatgaaaaaatgctcatcgttactggccgtcagagaaatgcaaatcaaaaccacaatgtgatatcatctcacaccagttagaatggcaatcattaaaaagtcaggaaataacaggtgctggagaggatgtggagaaataggaacacttttacactgttggtgggactataaactagttaaaccattgtggaagacaatgtggcgattcctcagggatctagaactagaaataccatttgacccagccaccacattacttggtataaacccaaaggaatataaatcatgctgctataaagacacatgcacccatatgtttattgcagcactattcacaatagcaaagacttggaaccaacccaaatgtccaacaatgatagactggattaagaaaatgtggcacacatacaccgtggaatactatgcagccataaaaaaggatgtgttaatgtcctttgtagggacatggatgaagctggaaaccatcattctcagcaaactctcacaaggacaaaaagccaaacactgcatgttcttactcttaggtggtaaatgaacaatgagaacacatggacacaggaaggggaacatcacacactggtgcctgttttggggtgggggaatgggggagggatagcattagcagatatacctaatttaaatgaggagttaatgggtacagcacaccaatgtggcacatgtatacatatgtagcaaacctgcacgttgtgctcatgtaccctagaacttaaagtataataaaaagaaaaaaaagtatgtgtatgtatctatacatatttataaaagaaggcaacatagtgacagcctgttagagacccaatttgcataataaaagatcagggtggggtggccagcctcttcacgtactatataaagggcacacctggtttaaccaatcctctgtgccctatataaggcagacatgacttcctcaagctcatctataaaccaactgcatcttgctatgaacctggaaaccatttgggatctcttcctctgcaccagaaagctctcttctttgtttcacttattaaacttctgctcttaaacccactccttttgtctgtgtctgtgtccttgatttcctcggtgtgaggcaatgaaccttgtgtattaccccagacaaatgaggcagcttcattgtgggggcttgtccaggattatcaaaagggtgagtataggagtggacctcaactctgtccttttatttcagggctctcagcctccattttaattatttaattattttatttttttgagacagagtctcactgtatcactcaggctggagtgcagtggcattatcttggttcactgcaaccaccacctcccaggtttaggtgattctcatttctcagcctcctaagtagctggaattatgacacatgccaccacacctggctaatttttgtatttttagtagagatggggttttgccatattgggcaggctggcaccaaagttctgggatgaggtgtgagccaccacacctggcccttaacctccattttaaagtcaaatcaaaccatatactgtgtgtctgatggccacctagatacctctagtgtgagccatgcttctcaaggctcagatgacaggcttgttgggctgtcatgatagtgaatccactagtgccctcaggttgctgggcttattggttatgtttcaaaccaattttccttcatggaggaactagccatctcatggggcttgaagaagtcctagggcaactgacaatttctggccagggctaaaccttgatgtaattcaaaagctttgggactgaactcagcctccagctgctcaattggatcagcaacagaatctccagcttttctattgcagaatgttctcctttcctatccaccaccatcatgtctcctctctctgtatgcaatatcatgggaatttttacagttcagagaaatagtcctgttaggaaagatcaaaaaatgctatagtaactacaaatatagctcaagggaatgccacttttgtaactttctagaagcagaggtctcccccagcgagtgtttctacccttcctctggcaagcatatggtatttctaggtcagcagcgtcaactagtggagtatccttaccatgagtctcagtgttggtcctttgctgagacactccagcttcccaattctccctttttgtgcccctctaccagattccagggtttatggctttctgtaaatgggaaaaactatgccatgaaagatcaggaggaaaatgtcctctgaaactgttttagtctgaacactgtcccatcagcaggaaaaccaccatttgatccctatgttcttttaacacaccaatcctgcttgcagttaagacaatacttaaatagtaagggaattttaagtccagaagttaaccactaccattctctaggggtaaatcctttagcacgacccacaatagcaggatatagagttcaatcttgtacaccccctccattaaaggggccatgcccaaattcaactattacatagtctttcctgagatccatttttcagggagccatgaagatcatacaagtctaggaagtcagggtaatcaaaaacagagaactagggctgcatgggtacacatgactaaactcatcacttaattcctctggttccatggctggggaatcatgcctgcaaccatgggtagcatgtttaacaaggtgccaggagcccaggaaccaaagagagaaaacagtagggggaatgcccccactgtcttcccctccaccctgggccatcccaaggaaaggatccttttattctcagttctctttctagatgggtaacagaccatctttggcctgtactcctctcaagtgtattctaaagcactgggactcatttaaccccaaaactttgaagaaaaaagcagctcatttttctttgcacaaggggatggcattctttctagacctttgcaagcattgcaaaatcaacccagcttttttagcagtcatatcaggcaggtctgtagagaatgatttcccacagtaagagaagcaacttttgagggaaccatctgagaattccccttatctgaggcccctttaagttcccttctcattacagaaccttaggcagattaagggggtcttaggccatgctgctcctaagccaaaccctcactgctactcaaaaacaggcagctctgtaggcagtagaacattttggagatgaacaatatatctcctataataggccaaaaaggaaaaaaggagatagggaaggtgatatggtttggttctgtgttcccacccaaatctcatcttgaattatactcccataattttcatgtgttgtgggagggacccagtgggagataatttgaatcatgggggtggttttccctatactgttctcataatagtgaaggagtcttatgagatctgattgtgctatcaggggtttctgctttagcatcttcctcattttttctagccactaccatgtaagaagtatctttcacctcctgtcataattctgaggcctccccagccatgtgaaactgtaagtccaattaaacctctttttcttcccagtcttaggtatgtctttatcagcaggatgaaaacatggtacatcctacatcagcaagatgtaaattggtaccagtagagttggcgttgctgaaaagatacccaaaaatgtggaagtgactttggaattgggtaacagtttgcagggctcagaagaagacaggaaaatgtgggaaagtctggaaattttgcaaagacttgctaaatggctgtgaccaaaagcctgatagcaatatggacaataaggtccaggctgaggttgtctgagatggaggtgagaaacttgggaactggagcaaaggtgactctcattatgttttagcaaagagactggtggcatttggcccctgccttagagatttgtggagctttgaacttgagagagatgatctagggtatctggcagaagaaatttctaagcagcaaagcattcaagaggtgacttgggtgctgataaaggcattcagttttataaggaaaacagagcataaaagtttggaaaatttgcagcctgacaatgtgatagaaaagaaaaacccactttctcaggagaaattcaagccagctgcagaaatttgcataagtaatgaggagccaaatgttaatccccaagccaatggggaaaatgtctccaggtcatgtcagaggtcttcctggcagccgctcccatcacaggcccagaggcctaggagaaaatggttttgtggcctggggcccaggcctagggacttggtgccctgcatcccagccactccagctgtggctgaaaggggccaacatagagcttcagccatggattcagagggtgcaagccccaagccttggcagcttccacgtggtgttgagcctgtgagtgcacagaagtcaagaattggctgggcatggtggctcatgcctgtaatcccagcactttgggaggccgaggcaggcagatcatgaggtcaggagatcgagaccatcctggctaacacagtgaaaccccatctttactaaaaatacaaaaaaattagctgggcatggtggcggatgcctgtagtcccagctactcgggaggctgaggcaggagaatggcgtgaacctgggaggcagaggttgcagtgagcagagatcgtgccactgcactccagcctgggcgaccttcacctagatttcagaagatgtatggaaacacctggatgctcaggcagaagtttgctgcaggggcagggtgatcatggagaacctctgctagggcagtacagaagggaaatgtggggtcccatacagagtccctactggggcaccacctattggagctgtgagaagagggccaccatcctccagaccccagaatggtagatccactgacagcttgcactgtttgcctggaaaagccgcagacactcaatgccagcccattaaagcatctgggaggtaggctgtactctgcaatgccccaaggatagagctgcccatgaccatgggaacccacctcttgcatcagcatgacctggaagtgagacctggtgacaaaggagattattttggagctttaaaatttgactgcccctctagatttcagacttgcctgggccttgtaacccctttgttttggccaatttctcccatttggaatggctatatttactcaatacctgtaccccattgtatctaggaagtaactcacttacttttgattttacaggctcataggcagaagggacttgccttgtctcagatgacattttggactgtggactttcgggttaatgcagaaatgagttaagactttgggggactgttgttggaaaggcatgactggttttgaaatgtgaggacatgagatttggaggggccaggggcagaatgatatggtttggctctgtggctccacccaaatctcatcttgaattgtactccaataatttctgcgtgttgtgagagggactcagtgggagatcatttgaatcatgggtgcggtttcccccatgctgttctagtggtagtgaataagtctcatgagatctgatggttttattaggggtttctctttttgcatcttcctcattttctcttgtcgctgccatgtaagaagtgcctttcaccttccatcatgattcttaggcctccccagccatgtggaactataagtccattcaaacgtattttttcccccttgtctcaggtatgtcttaatcagcagtgtgaaaacacactaatacaaaacacaaagaaataatggaaacacctttcccaataggaagggaaacagtccctcctgacaatccctattgaaactctggtagctctgcaaaagaatggaaaaggcaacacttttttttttttttgagacggagtctccctctgttacccaggctggagtgcagtggtgcaatctcggctcactgcaagctccacctcccaggttcataccgttctcctgcctcagcctcccaagtagctgggattacaggcacccgccacgacgcccagctaattttttgtattaaaggcaacattttttaatgtacttatgagagggcttacaaagaactagggctaaacctgttaattactctaagctgtccttgatagaccaatagccagataagaattacacagcctttatggaaaggctgagagagctactaacaaaccacccctccttatcccttgattcagttgagggacagctcatcctaaaggacaagtttatcacacaggctgctcctgatattagaaggaaactgtgaaaggaggctataggaggatacaccaccttggaaaacctcctgagggtggccacttcagtcttttataatagatatcaggaggaggcccagcagcagaaagagaggaagcacaagaaaatgacagaggctgtagtatctacctgctttgcaggcttgcaaaattcaggatccccaaggtacatctgctagtggctatcaatgtggcaagtcagggcactttaagaaggagtgctcaggcagcaaggaaatgccacctcagtcttatccagcttgtggcaaagaccactagagatcagactgcccccagtgatggaggtcactgtgttcagaaccagtctcacagatggtccaacaggactgatgggttctggggctcaaacccgtggctccagtggctcaaactgccattacagcacagaaaccccaggtgattctggaaattgaagaaaggaaggaagacctcctcctggacactggagccagcctctctctctctctctctctctctctctctctctaatccaggccttcccacttcttgtagcaccaccataagggacatctcaggaaaaactctaatatttttctcgaccccttagttgcagctagagggacctattatttacaaatacctccaagccattgtcacagtgaccctactggtcctagatgccacaaattaacctcggaaatgacttaaatgtttacacctcacataatgtggaaggattactgtcctctagggggagcctttggctaatagtcggctccttaaatattaggctctgctcttagagggttccacaatccagttaaaaacttgttctcacctaaacctagccactttcctccccaaggaaagtggggaaaatgaacatgactgtgaacaagttataatacagacctatgcagccagggaagatctcagggaaaatcccctagaaaatccagactggatcctcttcaaagatgggagctcctttgtagagaaagtaatcagtacggcaggattatgcagtagtcactctaaatggcatcattgaaaatgtgtctctctctccaggcacaagtgctcaattagctgcactgacagatcttaaaagaccacttgaattaagcaattgaaagataggtaacatttacactaatttgaagtatgctttcttagttctccatgctcatgctgtcatttgtaaggaaagacactgtcttacagataatttatggcctataaaataccaccccaaaattaactggttattatcctcagttttccttccatgagaaatagcagtaatgcattataaagggacatcaaaagagagcagatgaagtagatgaagaaaataggtttactgatcaggtagctaagtcagtggcaaggaagccttagcacatcaatatacttcaagcccctctaatctggaaaggctccataagaaaaattaaacctcagtactcccctgcagaaatagaatgcatcacttctcaaaggtatactttccagccttcagggcggctacactcagaggatggcaaactcaacctgccagcctccagccaatggaaagtccttaaatccaccaagcatttcacttaggaaaggataaaatttatcagtgtgtccagaaattattttcaagagagaatttattaagaacagtgaaactggttgttaacacttgtgaaggtgggttttttcttctcaaacccaaaggatgggaagctttccaggggaggactggcagacttcacccacatgccagagatgaagtgtagtcaatacctcctggcatgtgtagaaactttcactaactgcatagaaatctttccatgccatacagaaaaggcctctgaggcaataaaattgttaacgaaataagtcctcactttggtctacttaagtacctccaaagaggcaatggccccccatttaaggcaggtgtcatgggcggggatgtggggtggatctcaaacacactaggcatacagtgtcatctctgttgtgcttggagaccccagtcctaaggaaaggtagagaagacaaatgatactatcaaaagacacctcagaaaactgtcccaagaaactcattttccttgcactactcttcttcccatggtcttactgtgggcaagaaataccccttcaaagttaggtctgagcccttttaagatgctgtatggatgcccttttcttaccaattattttctgttagatcaggaaatatctgagttagttaagcatgtaacctctatggctcactttcaacaggaattaacacagttagccaaagcccaaccccaagaaataggaccacctttatttaaccctggagatttggtattggtgaaggctctcccttctctttctttctccctgagcccaagctgggaagggctctacactgttcttctttcaaccccctcagcggtaaaagttacaggtatcaactcctggatacatcacactggagtcgaagcctggaaagctgtgggagcaacccctgacagccctgaggaacatcctgaatatcaatgtgaataaataggagatctgaagctacaaaccataaaaggtaagtgagggctacccatcttactcagtcccacctttatctcatgaaatactttcagtcatttctacttttctgtttagatttgccaccagatattagaacttctttttaatgcatatttgcagaaagattttaattatccttgggattacatgtacaacttcatagacccccagacagaaattctatgtcttggcaagtaaaaattttcaatggaaattatctactacaccacctttgcaggactgtatactcactctatttgcagtaggactatatactgtagaatgcccagagtggaatgctggataaagagtctcaactactgtaatattttgctgaattattatccttatagcaggcataatagttacctgacaggaagtaaacataaaagttttactatcactaagtctgctaggatgttttattgggtttgtcaatatgtcacactctagttattcaaagaaggttataaagaaaggtgattttatataagaaaggatcttctatggtaaattattgtcctaaaaggaaataactggtagttcaaagagggatgtttagcacaaatcagaaagtttaagcatgtcataggtagtctgtggaggttgtgaaagtattaatagttgctggaaaatttagccaaagttaacactaaagttactctagccacccaaatccaatgccacttatcctaaaaagaatgttcctttttttttttttttttttttttgagacagagttttgctctgttgcccagcctggagttcaatggcatgatcttggctcactgcaacctccacctcccaggttcaagagattctcctgcctcagcctcccaattagctgggattacaggcacctgccatcatgcccagctaatttttgtattattgtagagacagggtttcaccatgttggccaggctgatcttgaacttctaacctcaggtgattggcctgcctaagcctcccaaagtgctgagattgcaggtgtgagccactgcacctggccaaagaatgttacttttatattaacgtttctgctaaggtacagccacatttggtggaggcaaactagtattacaatccattagaatagctaacagatatcaaactctactgccatgcttatcacctatagtacctccactaataatggtaatctcaatacttatattcaaaccctatattctaaatcttcttgtaaaatttatctcttttcatctagaagtaatcaaactccaaatggtgctgcagacagaaccatccatggacacgcctttcttctgaggacccttagattgaccccaggaggagccctaactgctgttccctacacaacactccttttcagcagtaagtaccagaaagactcatcatccaacaccccctaacagcagttagggataccactcctgagggggaaatgatacagcagctaaacataaattatttaggcagattgtgaggacaaaagagtcctcagtaaggtttccttttaacaaatagcagccccaaaattatttctaacaaaaagcagcctgaaaaatcaagctgcaagcatacataagcaagctggaagcttgcgctggcagctctgccaatagaaaagggatagctggaagccggctatagtcagcatggaggttccttttcccctttttcaccacatgtgcagtaaaaagcagacaacatggtaccagtccagtagagaccccatttgcataataaaagattacagtggggtggccagtctctttatctgctatgtaaatagcacacttgatccaatgaatcctctgtgccctacataaatcagacaacacttcctcaagctcatatataaaaccaacccagaaacctgtttgggacccccttctctgaatgaagaagctctcttctttctttcaactattgaacttctgctctttaacccactccttgcatgtctgcatccttgattttcttggcatgaggcaacgaacctcagttattaccctaaacaatgctgtgtcaactcctctcgtaatgctagtttgcacagctcatggctccaaaagagaccccttccttttgaggaaaggaagagagaagagcacggagaagtttgtcttacatcttggatatcagcttagccacagcaggacaggaactggtcagtcataagaccccaattccaggccctagcttccagatgacatttctagacacaccctgagccagaaggtaacccaatgccttgaaagaaagaatcaagttttggcagcattcatcacctggtaactgaggagctcttgggccatgaataatcagcagtaatacccaggtactctgttgaggacatttggtgattctctgagacttactggcttcaggtgagatccagcacattgccaactgtgttgactacgaggcaaaactcctgcttgagaaaagcagtagaaaaaataaaagagattttggctcgcaccttaggtactagcatggccacagggttgtagagcaccaagaaggctcatggggaccctattccatgacttcacttttgaattacatttctggatctgccctgggccagaggggagcccactgtcctgaagggtgagtcccagaccaggcaacatttaccacaagctgactgaagagcccatgggccttgagggaacactggtggtagtctgtcagtactccgcgtggcctggtgtggtggtggcaatgaggtgaaacttttcttcctttggaaaggggaagggagagtgagaagaactgcatcttgtgctttgagtgccacctcagctgcagtataatagaacaccaggcagacctctaaggttttttactttagtctctgacacccacatggcaactctggacccacatggggcctgggggagctggctgtcctgaagggaagaacactggcctggctggcttgccataagctgattatagagccctagggccttgagtgagcataagtagtagccagaaagtggtcacagcagaccttaggtgagacccagtgctctgtgggcttcagttctgacccaggacagtcacactaacagcagggagagtcatagtgttggtggccataggggtgcttgtgtcactccaccttcagcattaggtggctcagaacagagagagattgtttgattagcagaaagtaagaaaagctaacaaaagcctctgcctggtaatctaaagaattcccacagattttgtttaagaccatcaaggtggtacctctctgagtctacaagaaccatagtgttactgtgcttggggtgtcccctaaagcagatacagcttagatcacaacacccaagttctttctaatatctggaaggccttccaaagtaaaatggctacaaataagcccagacagtgaagactacaatagatacctaactcttcaatgcccagacacaaactaatatctacttgcatcagtatcatttaggaaaacattacctcatcaaacgaactaaatagggcaccagggaccaatttgccttagtatctgttttcttttggttactctttagtgccttcaggaaggtttattttggttggtttgtccagagtttatagttgttacctgtgtgtatgtgttgagaacaggggacagagaggtcagtcacttttagaagtggaaccttaaagagctttttttgtgtcatatcatgtgcaaacctgttagaattcatgttaaaattagacatgaatgataccaaaaacatttcagcactatggtataaaaccataccttactgttgacctttcttttgcctattttgttcatacttactatttatttacttaaatccctcctcagttttaattcttgttttctaatgagttactgagtacttaccagatggaaagcactatgatagattctccatctgttgaaatattgctcattcaaaatccaaatcaaatgcaaacaccctccaaggatcactcccttgcctcctcctaagcagacgtgatttacttttatctgaatgcctttggtactttgtttttaccttatgacattagatttattaatacacttgctttctccccaccacaatcagttctttgtccctattagatcatacacttcatcagtaagggcaagtctcactcatatttccatccatccatgctgccttaaacatgctttctaaagtcaggaactaaaaaataaaaagaaagaatatctttgcagctgctcagaaagaaaagaaaataggacattagtttcctgtctgtgttctcaatagtaggatcggacatcagttaacaatgcattctttatttttagcgaacatctagacagagaaaactgtcttttcccttctcctcgttatttttcctctttcttcttcctcctcttccttcttcctttttcttcctccttttttcatcttgtcctcttcctcctacttacccttccccctttatcttcctttgtccctcctctcttctcactttctttttctcactaattatagtctcatttaaactttttttgtatgcttagtctcatctttaaaatggggaaacatatatgtgtcattatgaaatgttttttgctttaaattgttaaagatcagtaagggagtcttttttcttcacctttgaaattgtagtgccaaaactcagacaaaccagtgatgttccaaaagttgatgggagaagaacccaaacatttgattcttccttcattgatttttctttcattggtaagatattttagtgaaatattatatgttgaattgtcaataacaaaagccatctacaagcattctttttcctcttttagccatagcaacaaacatgccataaaatggaagttatagaaataaggttaagtgaattaaactaggttttgtaataagctcacttcttccttagactcaggtcagaagacatttaaaagaagaggatctatcataaactggggctgttgctggggttctagcacttgcctggacaatgtgtctgcaccatcaacatcacctatgcctggacagctctttggagtttctctgccaaatatgtgtgagaatgacaatctgctcaaacctgtcctggtaaggctcacttgacctgttagctaatgggaaagggggtttgggaaaggagagctctgagaggtaaatatgtcaccaaatggaaaaattatagacgccactgtctttggctaaaaatctgatttaactactgtagaatcataaggaagacatatagggagagatcatatagtttcctgatttcaggaaagacccacataaacctactcagataaattagaattttctctttagacagagaattcacattctctcacacaaatcctttcttcaactccacattgttatgaaagtcctcttttatcagtgtagcagcagagactactcaatgttatgcttaagttttaaaaacttttattatttatatgtcaagtacttaagcataaaggtacgttccctggcattcatttatcttttgtctgtagaatgggtcagatgaaaaccactgagttatttccagttgacatattaaagaatcactactaagcagcatttattgagtattcattatccttcaggtgttatactagatgtgtggcatttaatgctatattgttcatctataagtgccagacactcatctagccaccttattatttatccttcacagcaaacgtaggaggtggttcttactatgtcaccatctctacttcatggtctgtgttttcaaaagcctcagtactttactcaaggatacatagtagctaagtggcctaactaggttttaaatcctacagattgcttgtctccaaaacccattctcttcctgcactgtaagcagaggacatactgatacaaagaaagcaaaattagagaacacttaaaatccactctcttagccatttttagaaatgcagtaccttgttattgagtatagtaatcatgttatttaatagagcacctgaccttacttctgctatctaactgaacttttgtatcctttgaccaatatctccccaacctcaccaccaccccagcccctggtaaccaccattgcgctccccaaaaaaattgacttgaatctttctagctgttcttttagtcccaatcttttagtacttttaccctagcacaaccccatagcctctggtagccaaagggggtaagtatgtgccaaaaaggataagtattcccttgtctgtatgtgtgaaatgccattttgcttatttcctttgtttccctattggatgtacttttctttcttaatcaaaaaggacccctcaccaaaggtgtcttcaggaaagcagccagtttaaaatcctgcagaaaatgagaaattaaattctggaggtgaagtaaacctagattgtgaatctatttttgagatagcctctgtattgaaggtaagaaaaattttcttttaatctacctgatggtatagctctggagcaagaaaaaggtgtttttattttttttatgaacattatttatatttgcaaagacccataatcaatttataactttaacactaaaagagtgttacaaacacttttataaagtcaacattggactttaaaaactaccaccagtgatatgacatatcaaatatgtttaaaaattttttttcccacactaacctcatctttacttctgcaaccccatgtaaaaaataaaactttgttaaaataataaaaagacacacacatttaccaaaacaaacatcatgcctattagtattttctgtcttggccaggcatggtggctcacacctgtaatcccagcgctttagggggctgaggaggggcagatcagttgaggtcaggagtttgagaacagcctggccaataatggtgaaaccccatctctgctaaatatacaaaaatttgcatggtatggtggctcacgccagtaatcccagctacttgggagtctgaggcctgggaatcgcttgattcttggagaggaaggtaacaatgagccgaggtcacaccactgtactccagcctgggtgacagagcaagactctgtctcaaaaaaaaaaaaaaaaaaaaaaaattctgtctcactaccttcataataaaggcagttttcaaaactaaacttttgttgcatgtttgaaaatagttacagaggtttgccataataaacatttgcctcacaactgaaacaaaaaaaattgctgagatcactgaaatttttgtttacataaccattacgcccaaaaatactcttttccttgttccctaatgccttttactctaaaagtggagtgggaacaatctcagcatctgagttccttttacctttaccacatttgatattctttgtggttcttaccctttagccatggctacaaaagtcacatatatagttacagagatagagttctaattttttttctgccccacattcttgcaaatgccctacctttttggaaaacctcaagtcaaaactagcttaaagcagagattttgaccctacagtatcttctgcagacctgcctcaggctcccaccttccaaagggctgaaatgcaccagagcccggagtagagacaaggccccagcccatatctcagggcctgcagcataaaaacaaaattaaggaaaatatggtgaagaagactcttgcatacccctacttcagcggagtggctagatgccgataaaatcttatgtcatgacttcatgtacaatcagacattttttgataaacgagccatgtcttttcttaaacccagccgtagacttttgcaattaaatattaggccagagaactgaagggcttgagctaaggtcatttaacctgtttgcagagggtttgtgattactcttcaatcctgcaaaacaataaagacctttttttttttttttttttgagacggagtctgtctctgtcgcccaggctggagtgccttggcgcgatctctgctcactgcaagctccgcctcccgcgttcacgccattctcctgcctcagcctccgcagcatctgggactacaggctcccgccaccacgcccggctattttttttttttttttgtatttttagtagagaccgggtttcaccgtgttagccagggtggtctcgatctcctgacctcgtgatccacccacctcggcctcccaaagtgctgggattacaggcgtgagccaccacgcccggccaataaagacatgtttgatttatttagccccagatatatatgccaaggatttttatgcataatgaatttttcttttttctttccatataattaggttttcttctacttcttagtttacaaaggtaaagcctgtgtttcatggaataattttttgaaaaccaaaaatgtctgcaaaaatttatcttactatgctatttttcatagcaccatacttcttaaaattttgtgctattgatgctgttgtaaagaagcatgattcttgaaggttaaatgtgttacaaattggagaaatatttgtccaaaaataatgaaaagacaaaaaatgatccacatgattgaagagtctgtttaaatgggttccaagtaaatgacattttatcatataagtaggttttactcacttttcttccaagtggttgcaggaagggacataatttttgccaaagtttttgagtttttgttttgtttcttgttttaaagtctattttgaagtggcacttaagttttcttgtaatttttcacttatgcactggttatgcttagatataagtttagtttaagcctcaccttgacttttcaaactataattggacaaaaatgcttgagatactatagcttggatccatcagattttgagaaaaagttcatatttactcctgcactatctcaactcatgagtttgggaattctgccgatgatctgggctctggttttggaggagaggagacttttagttacatgctgtgagttggtgattgcaattcagaaccagctttcacatccttctcagctgtgatggtggctgaatttcaaaacttgttatttcacctgtgggagagttcattgagatgttatgagttattttctttcaagtgtaggtttaagatttagtggtgtttttctttaagacagatcataagtatatttttcactgagatttaaaaggaaagctattgtcactatcccgttttgaaataacagattttgctgcttctaaactggacttctaatgtgcatacagcagctaaaattagtttggaattatgaaaatttaatagctgtatccccaaagaggtaacttttgtaattatatccctgaatcacaaatattcaggtacatttctactactggaagatataatagaacaaaggaagagtttgaatcaatcagtcttctttctttctaaaaaaggtatagcaataaattgataccactacaaagaggttcttcaaattgttttagaatctcagttccagttgattggttttttctcggctctcattaatatttggccatatgacatatgacagcacttcactaatgacctccactgtggctgggactgtgcttgacattgacatgtaaaaagaaggttaagagtctgctcctaccctggaggagctcataagcaagtgggaaagatgcctacacaatcagccaactgtaacaataagttatcacagcttccatattagtgttagaaacatgatatctaagtaaaacatggtgtgttgcctttcataagacatatagagaaagttattgatttggttttccagcaagagttaaaattgcccaattgaagacttttacctgtccccatgttgtaatcaggaaattgcaagaaggtaaacaaccatgggtacagtgcttaaatatgatattgagttcactctgcctaaagtttactgaggtggagaacagactgcaagcttgatcttggtaatgtcatgccaacagcaacagagagagttggcctaaaatcaactctctaggatcaggacaagaattgaatttagttatttttaagctttttgtaaacaaaagccaaacaacaaatgccattggtcatatccttttgtgtcatagtgtggtttcatcacactcagccctgccagtggtctcagcataatagaatctctaagaaaagaatatactgtggacatgttatttagtgtacatcaagtgtgagaatgctgcccccatgcttccaaatacagccatcacgtggaatgctttctctctccaaatgtaagagaacttttctatggggaatatagggaaaaagcttacatacctcatgatgcaatcatggaatactgctggatataaagttctaagataatagggactgtgttttatctactactctatccctagtgactcaaatagtggttggcacacaagaataaatgcacatagaatgattgactgaatgaccaccaaattattaacctcatagataccttagtgcatttccatgaactagccatctaaggaaagagaaaaaaaatgatttagtatagtttactgccagaccctgtcagatttgactagtttgctaaaatgtatgcaaacaggaggtttcagccaaattggttgttctttgcctttcccatcataatgcagacttcaattatttctataattttttttagaaaaaaacaaaaaatacttctgtttccacaagtcagtggagagttggcacagaggtctgtgtagttccctgaagagagtacttaagtgaacttttcaagaaaatactttctgatttatctaacacatacttggcatgagaataataatttaaaatacctgtttttccatcaatgtaaagattttctgcaaagtattccaggaagtgttttttgtcagatctctgtgatcactgggtctgggtaatggatgagggaaatgatgaaaagaaaataaattctgttcaaatgtaattagtctaatttggtcgtgtctcaaaaatactattaaaaagattttataagcttgtttattaaaataatgacaaatatcaaagtcatatccatggggaccagattacaatatatttatgctggcttatcattgttattgtttttctcctttagcttattaacatgaaatatttaagcattgtataccttctgtatatccgaatctgataggagttgatattcattagtctgctagctaatactgtaggcccaatctacagtttatgattgtaattttggtaaatatttaaccagacaactcatcatatatttcattcaccaggtgaagtcatagagattatgacttattctctcttctcagggaactcacactctggtaaagtagatagatgaccaagaattacaattacgatgcagtataatcagtgctgtaagagatatttggagagtgctgtggaagcatggtagagaggcagttagctacttaaaaagtgtcaaggaaaagggggattgctactctctctactcatgcaaaaaaacaaaaatgctggtagaactcaggaccccatgcctaaatatttcctgcattataaaagaataggaaagaaatatccattaacaaaaagcaatacttctagttctatgaaaactcaatatttttcacttgcatgttcttatttagtactgtgtgttttttttcttgagcaattttcaaatatgaattatctacatctttcaccaataggagaacatagtacagctgctgaggacaccagaaaccaagggcatttatcaaaacactatcttcacttacattatagtttggcgtaagtcattcagatagtgagcatcaaattctatactttatttctaattgtctaaaaccttatatatcctataagctgttaaaggattttttaaagtaaaattatgactctcatacaaatgtaaaataaacacatgaaagattttatttaagtcatttatgagggaaccagtaagatgttacaaccagttcaaaggagacttcaaagttgaaatattatatatatagttgaatcagaagtgctaaaatgtggggccaggcacggtggctcacgcctgtaatcccagcactttgggaggctgaggtgggcggatcacctgaggtcaggagttcaagactagcctggcctacatggtgaaaccctatctctacaaaaaatacaaaaattagctgggcatggcggtgcctgcctgtaatctcagctacttgggaagctgaggttagagaattgcttggacccgggaggctgcagtgagtcaacatcatgccactgcactccagcctgggtgatagagtgaaattccatctcaaaaaaaaaaaaaacaaaaaaaaacaaactccccaaacaaacaaacaaacaaacaaaaaatgctaaagtaaatttacaaattgatacaaacaaaactggccttttctaccagggcaggggtacatgcggctaaatcacttgtctctccaccagacatacttttcacatcattagaccagtgttagatgggctgctgtcagttatttataacttgtaaagttacaaaataactcttcttgtgaagaagcttggggccccgtagaagcagataacccagacgcttatgctagatgtcttattttccattgaatacacccagtaatttttttgttctatttaaaagtctttcataatttatccttacaaaaactatattcattgttagtccattgtattgcaaaagacctgcctgctatttgtggagcattattcagactaccttgtttgccctagcttgcaggtttttattgaaaaaaagaacagtcatcaatatcagcatgcacacacacacacatacacacacaagcatatatatatatatatatacacacacacacaagcacatatacatatatatgtttaaatagtagtaatcatttttggtgagtgaccatttcaaaatctcttatcaactacaaaatgagaactgtagaaaatataatactataagcaactcatatgtgaaaatggtacaatgagacagatttaggacaaaattgaccttaaggttttgattctttccaagacagcatttctgggttactgcttggaaataaaggtatactttaaatttcattgctgtctaatttgatcagaaagctttttgtgggttttagttgttaatattctgaaatgttaaagggttgacctaagtttaaatgcattgtactagtttcagggaaatatttcaggcatcatttttatgaggcattttctgcattattttacatttttgagttgtgaagacagtgtacaaaaacaaaaaaattcccagtgcttattttttctttctgtccagacagtcctcacttgtgtggtatcatgttaactgaaacttctgcatatatgaaccatgttgttgatttgcactcttccccatgcaaagtgaaaattgcatgcctttgcaagtttttaaatacaatgtcttgcttaaagagtgcatttttctttctttacgctatgagaccagcttctgagtgccaatgttgttagcctaaggtatctctttggtatattacacaatattgagcaacaatcctcaatcaatcacatgaatgcatataatttagtggtatgtgtcacttcaagcattatttggtctcctacctcctccatccaagaactaaaagatgaatttaaaagaaaggtaataaagtttttcacttttatgccttgggggactgagcccccattttgaaactgaaatccagagtatcaattctgaaagatgatttcttacataacttaagtacacatacttcttataaatttgattttactgataaactataggaaagtgatttgttaagtagaaaagtgatcacaatcaggttgcttctttcttccctttaaggagtctaaacactaagagtaaattaatcataaagtgataaaacagttgatatgagttttcagattcaaaaaacaagagaactttggagttaggccagcccagattcaattctcagtcccacttcttgccaggcgtacaatcttgggcatcattcgttacattgacctaaagtgttatctgaaaaaaaaatggggttggtgataatagagtagttacttgaaatcacagttttgcagtgcctgacagttaataaggggcttggagatatcagttgcctttgctctcaacgtttctcctgccccttggccccagtcctggagcacagaaactacagaaaggttccagtgcatctcagtggaggcacacaatgtccctagtaatctctgacctctcccccaggtgccactagttagggagtctagtgaaatgctacacaggggtagaccagtcagtccaatgcatgcatgggtagagactagacagggaaaatacaagtttttttcctagctgtctttctttttcacgatgcacccacagatgagccctcctcccaagtttatgacaacctgccctttatataaggaatacttttcataagcctttgtctaatgatgctttataaacattaataacacagtgtatttgtttaccccaaacatcctatggagaacacttatatccaaattttaaagacagagtcactggtataaaattgtagcattaagccaaggccagaagtaaaaactttagtccactaattaaatttgtatgcgcaaactacctttgagagtatcatagatttttttggggaaagtgtttcatgtacttttaaacagatataatttcttttgagtacatttgctttttttgctgttaaaattaggattcataaatgaaaagggatttataaacctaatgtgaaaagtaatacttcatttgttctttttttgtacagtattgctgattatacaatttccgattgaaaattgttgtataatatttggagaaaaaatcacttttctcttgggagaggtttcagtgagatgtgacactggggagaatgcctcaggtattgtgaataattggattggtttttgtgaataattaggttggttttcaagagaaacagacacatgtctgtgaagatgctggggcaagagtgttcctgaagcccagagcagctaaagtaaaagtagcctctgacctgggtcactggggcccagggcttctgatcctttcttagaaaatctgctaataggtcaatgtatatgaacaatatagtggcaataagaaatgtataagactgggttccagctttaaagttgttagtggcagcatgctatagtactaaggtttgatgctttttttgaacaaaacaaacattacgagtaaccctaatacatataataatagaaatgctgtggttgaaactcaagtagaaaacccagagctagaggggcaggtatgtttttttctttctctacttccttgtactggtccctgagacacatcagaattctagtgtgtatgaaacagtttgacaactactggcatcatttggttggtgggggtagacagaaatttcagatatacaaccttccagaaaatgacttcttgtatcagccattcctaaatgtgttatctttggccaggaacatcactgttttcaaccctaaaatatgagtaaaaataatgtcgaatttttatggttgttgtaaagattaaattaattaaataaaaaattattaaagaactttttagaagagatattgatagagtagtaaataattttttttaacaacagttaatattagtgtgtaaccacaagcaattgatgttggaaggcagaggcttacttagaatctgggtatacttggccttaattctttcatattttacactatttcttggttatacaacatgttcattgctttaagaaattcttacttatggaaagcccattgatcagaaactgagataaatctcttgtatcctaacagttttatttttattctgcactaacaattggggaaattataaaatattttctcttttttttttttttactatgctttaagttttagggtacatgtgcacaatgtgcaggttagttacatatgtatacatgtgccatgctggtgtgctgcaccaattaacttgttatttaacattaggtatatttcctaatgctatcactcccccctccccccaccccacaacatgccccagtgtgtgatgttcctcttcctgtgtccatgtgttctcattgttcaattcccacctatgagtgagcacatgcggtgcttggttttttgtccttgcgatagtttgctgagaatgatggtttccagcttcatccatgtccctacaaaggacatgtactcatccttttttatggctgcatagtattccttggtgcatatgtgccacattttcttaatccagtctatcattgttggacatttgggttggctccaagtctttgctattgtgaatagtgttgcaataaacatacgtgtgcatgtgtctttatagcagcattttttataatcctttgggtatatacccagtaatgggatggctgggtcaaagggtatttctagttctagatccttgaggaatcaccacactgtctcccaaaatggttgaactagtttacagtaccaccaacagtgtaaaagtgttcctatttctccacatcctctccagcacctgttgtttccggactttttgatgatcaccattctaactggtgtgagatggtatctcattgtggttttgatttgcatttctctgatggccagtgatgatgagcattttttcatgtgtcttttggctgcataaatgtcttcatttggaagtgtctgttcatatccttcgcccactttttgatggggttctttgtttttttcttataaatttgtttgagttcattgtagattctggatattagccctttgtcagatgagtagattgcaaaacttttctcccattttgtaggttgcctgttcactctgatggtagtttcttttgctgtgcagaagctctttagtttaattagatcccatttgtcaattttggcttttgttgccattgcttttgttgttttagtcatgaagtccttgcccatgcctctatcctgaatggtattgcctaggttttcttctaggatttttatggttttaggtctaacatttaagtcttcaatccatcttgaattaattttcgtataaggtgtaaggaagggatccagtttcagccttctacatatggctatccagttttcccagcaccatttattaaatagggaatcctttccccatttcttgtttttgtcaggtttgtcaaatatcagatggttgtagatacgtggtattatttctgagagctctgttctgttccattggtctatatctctgttttggtaccagtaccatgctgttttggtaccagtaccatgctgttttggttactatagccttgtagtatagtttgaagtcaggaagcatgatgcctccagctttgttcttttggcttaggattgtcttggcaatgcgggcccttttttgtttccatatgagctttaaagtagttttttccaattctgtgaagaaagtcattggtagcttgatgggggtggcatttaatctatgaattgccttgggcagtatggccattttcatgatattgattcttcctaaccatgagcgaggaatattcttccatttgtttgtgtcctcttttattttgttgagcagtggtttgtagttcttcttgaagaggtccttcacatcccttgtaagttgtattcctaggtattttattctctttgaagcaatagtgaatgggagttcactcatgatttggctctgtttgtctgttattggtgtataagaatgcttgtgatttttgcacattgattttgtatcctgagcctttcctgaagttgcttatcagcttaaggagattttgggttgagacgatggggttttctaaatatgcaatcatgtcatctgcaaatagggacaatttgacttcctcttttcctaattgaataccttttatttctttctcctgcctgatttccctggccagaacttccaacactatgttgaataggagtggtgagagagggcatccctgtcttgtgccagttttcaagggaatgcttccagtttttgcccattcagtatgatattggctgtgggtttgtcataaatagctcttagtattttgagacacgtcccatgaatacctaatttattgagagtttttagtatgaatggctgtagaatattgtcaaaggccttttctgcatctattgatataatcatgtgatttttttctttgtttctgtttatatgctggattacgtttattgatttgcatatgttgaaccagccttgtatcctaaggatgaagcccacttgatcatggtggataagctttttaatgtgctgctggattcggtttgccagtattgtattgaggatattctcatcaatgttcatcagggatattggtctaaaattctctttttttgttgtgtctctgtcaggctttggtatcaggatgatgctggcctcataaaatgagttagggaggattccctctttttctattgattggagtagtttcagaaggaatggtaccagctccttcttgtacctctggtagaatttggctttgaatctgtctggttctggactttttttggttggtaagctattaattatagcctcactttcagagcctgttagtggtctattcagggattcaacttcttcctcgtttaatcttgggagggtgtatgtgtccaggaatttatccttttcttctagattttctagttcatttgtgtagaggtgtttatagtattctctgatggtagtttgtatttctgtgggattggtggtgatatcctctttatcatttttttattacatctatttgattcttctctcttttcttattagtcttgctagtggtttatcaattttgttgatcttttcaaaaaaccagctccgggattccctgattttttgaagggttttttgtgtctctatctccttcttttctgctgtgatctagttatttcttgccttctgccagctttttctcctgtttctcctgcttctctagttctctatgtttgctcctgcttctctagttcttttaatggtgatgttagggtgtcaattttagatctttcctgctttctcttgtgggcatgtagtgctataaatttccctctatacactgctttaaatgcatcccagagattctggtatgttgtgtctttgttctcgttggtttcaaagaacatctttatttctgccttcatttcgttatgtacccagtagtcattcaggagcaggttgttgagtttccatgtagttgagcggttttgagtgagtttcttaatcctgagttctagtttgactgcactgtggtctgagagacagtttgttttaatttctgttcttttacatttgctgaggagtgctttacttccaactatgtggttagttttggaataagagtgatgtggtgctcagaagaatgtgtattctgttgatttggggtggagagctctgcagatgtctattaggtccacttggtgcagagctgagttcaattactggatatccttgttaactttctgtctcgttgatctgtctaatgttgacagtgggttgttaaagtctcccattattattgtatgggagtctgtctcttgcaggtctctaaggacttgttttatgaatctgggtgcttctgtattgggtacatatatgtctaggatagttagttcctcttgttgaattgatccctttaccattatgtaatggccttctttgtcccttttgatctttgttggcttatagtctgttttatcagagactagcattgcaacccctgcctttttttgttttccatttgcttggtagatcttcctccatccttttattttgagcctatgtgtgtctctgcatgtgagatgggtttcctgaatacagcacactgatgggtcttgactctttatccaattttccagtctgtgtcttttaattggagcatttagcccatttacatttttaatattgttttgtgtgaatttgatcctgtcattatgatgttagctggttattttgctcattaattcatgcagtttcttcctagcatcgatggtctttacattttggcatgattttgcagcggctggtacccgttgttcctttccatgtttagcgcttccttcaggagctcttttagggcaggcctggtggtgacaaaatctctcagcatttgcttgtctgttaagaattttatttctccttcacttatgaagcttagtttggctggatatgaaattctggattgaaaattcttttctttaagaatgttgaatattggcccccactctcttctgggttgtagaatttctgctgagagatccactgttagtctgatggtcttccctttgtgggtaacccgacctttctctctggctgcccttaacattttttccttcatttcaactttggtgaatctgacaattatgtgtcttggagttgctcttctcaaggagtatctttgtggcattctctgtatttcctgaatttgaatattggccttccttgctagattggggaagttctcctggataacatcctgcagagtgttttccaacttggttccattcttcccgtcactttcaggtacaccaatcagatgtagatttggtcttttcacatagtcccatatttcttggaggctttgttcatttctttttattcttttttctctaaacttctcttcttgcttcatttcattcatttgatcttccatcactgataccctttcttccagttgattgaatcaactactgaggcttgtgctttcatcacgtagttctcttgccttggttttcacctccatcaggtccttcaaggagttctctgcattggttactctagttagccatttgtctatttttttcaaggtttttaacttctttgccatgggttcaaacttcctcctttagctcagattagtttgatcatctgaagccttcttctctcaactcatcaaagtcattctccatccagctttgttccattgctggcgaggagctgcattcctttggaggaggagaggcactctgatttttaatttccaatttttctgctctgttttttccccatctttgtggttttatctacctttggtctttgatgatggtgacatacagatggggttttggtgtggatgtcctttctgtttgttagttttccttctaacagtcaggaccctcagctgcaggtctcttggagtttgctggaggtccactccagaccctgtttgcacggaggctgcagaacagtggatattggtgaacagcaaatgttgctgcctgatctttcctctggaagttttgtctcagaggagtacctggccgtgtgaggtgtcagtctgctcctactggggggttcttcccagttaggctactcgggggtcagggacccacttgaggaggcagtctgtccattctcagatctgcagctgcatgttgggagaaccactactctcttcaaagctgtcagagagggacatttatatctgcagaggtttctgctgccttttgtttggcaatgccctgtccccagaggtggaatctacagaggcaggcaggcctcctggagctgctgtgggctccacccagttcgagcttcccagccactttgttaacctactcaagcctcggcaatggcgggcacccctcccccagcctcactgccaccttgcagtttgatctcagactgctgtgcttgcagtgagccaggctctgtgggcataggaccctccgagccaggcatgggatataatctcctggtgtgtcgcttgccaggactgttggaaaagcgcagtattcgggtgggagtgaccggattttccaggtgctgtccatcaccacttcccttggctaggaaagggaattccctgaccccttgtgcttcctggatgaggtgatgcctcaccctgcttcgcctcatgctcagtgggctgcacccactgtcctgctgtctgacaagcccgagtgagatgtacccggtacctcagttggaaatgcagaaatcactcatcttctgcgtcgctcatgctgggatctgtagattggagctgttccgattcggccatcttggaacacagagccccaggaaatttttttattttctggattcaggtgaataatgacaagaccccacaatttgaaaagacgtttactgttgttccttgcaccaacttttttcacccatgaattattcttgacctcagtgctgaaagagtaagtatgcaataagactaaaagggcataatgcattcaataagaatgctttttaatgaatgccaggtgcccagcactatgatggacatcatggcacacaccaaaaaagtgcaaaagaaaatcttatttattctgaaattaaaagtatataggaatggaggacatacatgtgtgaaataatttgataaggcatgtctgtgattctcaaccatgttatttactctacataaaaatacatatttctgcacctcccattttacctctccactttatccttatttaactttaaactagattttcaactttaggcttgaaacatcatttttttctggaagaccttatctagttcctcagggtagatgttacaacagtatgttaaaatacctctctgaatttttatattttttatttttgcaattttttcaatgtccatcttctggtataagtgtattctacacagcgacagggactgtattgaccattggaatacaccagtgaatagcacttgtcattagtgagtacatgaaggtttaagagatcatttatgccattccccttatttaagggagtcaacaaaagttaaatgatgtgttgcacagacaggtgtaacagacccaccactacaatcacagctacagaccttctccagctgtcctttccactccaacatgatgcttcccctgcattatacaagaggatataagacagaatgagcaaaggaggatgttttccaggggagaaaagagtgaataggcaggacttatttgggaattatgggagatctttgctcttttttaaagcactcaacatttacaccaacagatgagcaaagtacattaagtatagtatgaaatgtaccagtcatttcccactaacatcttcaatcagagtgtccacaatcttcctttaatacttaagtcagactccatttttcatgggaacacaatcttgtttcccatttataaacaatttttttctctagaccttgtgttaaaatgatccaaaaatttctccattacatatttttaagctcatttaatacttacattttattctacttaagaataaagaaacatatatttggtcagatttttctggaaaaaatcaagttcttttttagaaaacagacttaatatatgtgaaaatttggatcatttaaaagttggaaataactagaaattaataaagagaaaaatatgtgttaaaatgttgcaacttcaaagcaaacagaaattttagtttttcttctcggcagatctgaatattgcaaaaatatttcaagtttgtagaaataattaaaacattcaaaaagaagtaacacaaatattaatatcagttaatgaagagaatttcaaagaacttcaaggaaaaatttcaagagcatacaatttatgtaaatcattgtcttctaaatacagaaacagtatgtgaatatcctaaaacattgtgaaaagaagttatctaaaaagcaatttggaggaaagagactattccaatgaacattttgcaaactgggaagatgcaaccttctgtgtaaaataaaggtgtgttccagaggacaaatgaagggtttggcttttatagagaaagttcccactcagattccaaattaggtccttttaagcaaataaagggtccagatttacttaattctggttgttcagcacagttgggttctgattggaggatgcacgccacagcctatctgttggtttaggtgatgtaaacaggaatagtcaggtataaaattctcaaagttaggcaagtgtgtggattttctggtaactcagagtaatgtgtgacctctatttagcaaatggccattggcttctttttaaagttatgcccagttagccacccaggctttctcatgaaggatgggttctttccagttctctgctttcagggactctccatatcttgcataacttttctttttgcttgttttctttcttctcttctcaaaaacctttcattaatggcaatgcttcatcccttaggaagaatgtcatatcaccgagcacagaaatttcaggcaggaagaggtttagaattttaaataatcaacaaggaaatttacataacaggagaaggaagaaatttaagagtctagtactaaaaagcttctccttctaaacccataaaacgttcacacctatttgctattttgacccagaagggctaaaagaaactaaataaaactactctacttatggagttaatctaacaaagtaatacgtatctattctgaattttgaagataaccttttaggtgatttgattttctgttggataaataaaacaagcatgctccaatgtcacacaacacacaaaagtgaataaaagggaaagttaacataggctggagatgagtactggtgagcgctcttgacaagagaagctcttgatgaattttaatgtatggatggcacattttattattttatgatgtcacttagacaaaaaattaaagcagaatggagagctgaatttgtgcttgttatgatggaaatcagagagatatgttggggtgtaactgtatatcatgagaagattgcaattatagatgatgcaatgaaagatgaagccgaagcatggttgctacatctaacctgaagtgcatgatgacaatgctaattttgtggcctcaaacataataaaaaccagtgcatccctcacctgcatgtttactcagaaagcatttagtgaaggcttaccatactcaaagcactataaaaatcttcctaggagaaacagatatggcaccaagggacagtgactgatttcaggttcatgatatattagctgcaccctggttagcattattcactctccacaaccaggaaatgtagtttgacagtggcctttctgttcagtttatttatactttctcatgttcaatttttattttaatcagtacaattttttaaagaagcctaaccaaaactaagaaagaagggtatggctttttagaaagcaaagacaaatagcaggttaggaattaaaatgtccacgtagaatttactgatatataaatcattgtattagccaagattcttttcattgcaaatgacaaacctttgaatacatttactttagaccaaatggaaagtttacttgtctgtagagcccacaggaatggttaaataatatgagcagggaaaccatgataaaaagaaattttgtggccaggcgtggtggctcatgcctgtaatcccagcactttgggaggccaagatgggcagatcacaaagtcaggagatcgagatcatcctggcaatcatggtgaaaccccatctctaccaaaaatacaaactacaaaaaaaattagccacgcgtggtggtgggtgcctgtagtcccaggtacttgggaggctgaggaaggagaatggcatgaacccaagaggcagagcttgcagtgagctgagatcgtgccattgcattctagcctgggcgattgagcgagactccaactccaaaaaaaaaaaaaaagaaagaaagaaattttgtaaggatttgaactgtggactcaaatgccaacaatgctgtctgtatctctctttgattggtttctgtcagaataccagctcaatttttatcacactcagtatatttatattgtggaaaatataaacatttattgttcacaattttatagtctatgacttgaacaaccaaatagatttcttcattggcctcatggatactacacttgctaaaataatcccctctagtaaatgtcatgggccacttagtgtatcgcaaaaattctccaataataaaatacataaataaaagtaatattttggttgtcatcttagtccatttgcactgccataccaaaataccacggactaggtgacttataaacaagtttaaaaactcacaataagtgaccagatttttttctcttagaccaatgacttgcaaccaagtaagaatgcagtgtctttcactggagcctcttggttggagctgagggagaagcactttcttaaagaaggggttggaggtgtgaaaaataaaaacaacctactagattatgtgtttgcagaacaatattcatcatgttattcagttcctctcataaaaagattcaaatgataaatgctcataatttaaaactgaaaaaggacttttttccccaaagctatttttattgggcaataaaatgacagagcccattatttttcctatttttgctgttgctaccagaagcttcagaattaaatcataatataacatcaataaccaacttgcatcaggtttatggaaaccatttccactattttctataaggtttttaaatttttctaatttttaaattatttctgtgcctttaaaatgcttttggattactttcagaaacagatgaagaaaaataagtaagtaattgacaaagaactcacaacattggcctcatgggtactacacttgctaaaataatcccctctagtaaatgtcatgggccacttagtgtacggcaaaaattctccaataataaaataaaatgcataaataaaaagaatattttggttgtcatcttagtccatttggacttccataccaaaataccatggactaggtgacttataaacaacataaatttacttctcacagttcatgatttaaaatacaaatgtcattaggtcataaacacagtagaataccttcaaccactcaagcttaattggtatgttccatctcacagacaacatgcttaaatacattatttaatattaattattacagactggtttaaaatataaaatcttcaagaaatactttaatttcccttggtgatggaaagtctatccctctgaaatataacaccttccaatttcctgtctctctacacaatgcagctgtggggatttttgagaaagtgacaagaaatgtcttcttgtccttgttgacagggttttatggtgattgaataatattttcagtttaaatatgtaaaacacatattacttcagtaaaatgcttagtacttgaaacctaccagaaaaaatgaaggtaatataaatcagtgcatagcagtttgagttgaattgtgatttaaattctcctgctctctcatagaggaaaaactgtgtagacagtagttttacatggacctcatcccagtttcaccatgtctgataacaaaactaatgcaaagatgcttctagtcataggcctgtgtcctctaaaaataagaaaaattaattgtgactgttcatctttccaagacaccccattcctatgcttctgatatgggtaaatatttgtaagagtattagcaacaaaacatgaataagccccacctccactctcaaaggtctaaagctggaaaggagtagtgaaattgaaaagagactaaaatctattaaacatttactataaacaaaacactgtgttaagtgtttggattatatataattcctgagtttatagagactgattcttgtaaagaacatcattatttaaatttaaaaataagtataataaatgtataaataagaaataaatattattataagtttttctatctggggtcagtgaactaaagctcatagacaatctcatctacaaaccattttcatgtagaccacaaactaagaacggtttattaaatttttaagaattgcattaaatggttatatgggtacctgcataatatatttgattttgcctaatggctcacaaagcctaaaatacgttctatctggccctttacaaaaatagtttatagatcctattctatagagatttgacctagtcagaatagtaaatagtatagatgaatgacaaattaagaatataaataaaacattttattaatatatttttatcagtaatttcatagaaaaatatacactcagaattaatgtgaaaatagattacttagttatttggcatatgcaactaagtggaaggccatatagtatgctggattcttgtcgtgtgtgacgtggggtcttggatattaggctttttgacatatatctattgcagaagcaatttttatggaaataaagtatattagtctgtgctcacactgttataaagaaatacctgagactgggtaattgatcaagaaaataggtttaattagttcacagttctgcaggctatacaggaagcatggcagcatcttcagggcggtgggactctgggcctggcccacaaaaccattctttcctcctaggcctctgggcctatgatggaaggggctgccaaaaggtctctgaaatgcctttgaaacttttcccccattgtcttggctactataattgggttcctctttacttatgccaatttctgcagcctgcttgaattccttcttgaaaaatcggcttttatttgctaccatatggctaggttgcaaatttttcaaacttttatgttctgcttctcttttaaatataagttccagtttcagatcatttctttacttctgcatatgatcataggctgttaaaggcagctaaggcaaatcttgattgctctgtaaattagaaatatcttctgccaggtatcctaaattattaatctcaagttgtaagtttcacagatctctagagcagggtacattacttccaagattttgctaaagaataacaaaagtgttttctccagtttccagtaagttcttcatctccatctgagaccccctcagcctggacttcattgttcatatcactatcagtatttttgtcataacaattgaacaagtcctaggaattcccaagctttctctcatcttcctgcctttttctgagcccttcacacactatcaacctctgcccaataaccagttccaaagtcactttcacatttttacatatctttataattatgacccactcctgatactaatgttctgtattaatctgtataaaaaatacctgaaatggggtaatttaaataaaagaggtttaattggtgcatggttccacaggttatacaggaagcatggcagcatctgtttctagggaggcttcagggagtttttacttatggcagaaggcaaagctaaagcaggcatttacacatggctggagcaggagaaagagagagtggggaggggccgcatacttaaaaaaaaaaagatcttgtgagaactgactcactatagagtaccaagggggaatggtgctaaaccattcaggaaaactgctcccatgatccaatcatctaccactaggccccacctccagcattgggattccaactcaacatgagatttgggcaggaagacatatccaaaccatatcatagagtttttcatagaaggcatccctgtagcatgggatgaagttcaatttaaaaaaaaggttgaaattattgtagaaagcaaggtaacttacttactgtcttactagagaatcagcaaagctcacaatgtccttggaggttggaataggagactgagtttttggataggcctgctgaaacatgacagcaggagtggtggaggaagaacagaggtctctagggttgcaatgaaagagatgttttgctttctctatatatcttctgatataaaataaaaattttgtcagtgtaaaaagaatcatattattaagactatcaatcactaaaataacaaagaacaaaatcaactattgtgatatcactgatgatatttgggaaagttcgtgtttctctttcacttttgaagaataacttcatgagtatggaattgtaggttgatgtttgcttttacctctcagtaaattcatttactttgaatattttccttctctctagtcttactcacatgatttctgagcagaagtcaaatgcagttattatatttacatcactatagttaagatgtgttttattcctctgtgtcctttcagaattgtcctaaatctctgatttttccttaatttgaaaatgatatgctgaggtgaacttttttagcattaatcctggttggtgttctttgagcttcttagatctgtagtttggtgtctgacattaatttaggaaaattctgtcatcattatttcaaattttttttctgcttttttttctctcatctctgtctggaattcccattatgcatatttacactttctgtagttgtcccactgattttggataatatattctgttttttttcaacctttgttccctttgcttttcagttttggaggtttctattgacaaatcttcaactcagagagtctttccccaactgtgtccagtctagtaataagcccatcagggacattcacagtgtttgtatctctagcatttctctttggttctttcttgggatttcaatctctctgcttatatttcccatctgttcttgcatactatctgctttatccatcatatcccttaatatattaaacatagttcttttagatttcctatctgataactctaaaatccaggccatctagttctggtgttagctctttctctttaaagtgttttgtgtctgggagtatgccttataatttttcctgagagctggacatgaagtagtgtattaagtaaaccacagtaaatagttctttagtattgtgacagtaaggttttaggagatgaaacattttctgtagttctacagttagatctcagtcttatagtgagcctgtgcttctggactgtaagccttacaactctttttccatttttttttctcccatcttaggtgaggcaagatggttagagtgggctgaagtttggtatttccattctccctcatgacaaggtagagcaggctggagttgagtattttattcccccagtttagttagcctttgctcaaactgcagtaggttagtatctggttaactaatttatcctgacaagagattaaaacaacaacaacaacaacaacagagtgttctagtatatttcaaagtggtctcttttttttcttcccctgctggaagcatgaggaaatttttctcctatatttactgtggctaagctcctggaggtaaaacttagaaaagggcggtgtctgttctgactaggtcaccctggatgtattaacagagacatgttcacacctagtctccagcgagttatcaatcatagttcagggtttcctaccttgacactggttcccattaaggcctctgttttaatatgtggtgattctctgtatttgcctgcttgtgtcttctattctgggcacagtggtttgctctgtggatctaagaagagttgttatttacttatttttttgtttgttcagtattttactttgtttttacaacagagtggtggcttccaagctttttcaatgtagaattggacagcagaagtcccatattattttcaagtgcccatgtaatagatacccaattgagccatattcttatcatagcacaaactttaatacatttaaggaattgaaatcttgcagaataatgtatatcgtaacaacagtggaatctaactagaaatgaataatagaagattacagaaaaatctgaagcacttggaagcagaacagcacatcctaaataatccatgggtttaaaaggaagcttccaaggaaatctaaaatcacactgaactgaatgaaaatgaaaatacaaattataaattgtgagatagagctaaaacagtgttgagagagaaatttatagcattgagtacatctttaatgaaagagaaaatgtattcaatcaattatccaagctcccatctcaagatcctagggaaaaataaaccacatgacacagaacaaaaataaaaaagttaagagagaaaattaagaaaacataaatactaaaacaataaagaaacatgatgaaaaaatctgatacaaatatcactaaaacttccaaacctctagaaaaacataataaaaaagagagaagacacaatatcagaaattaaagagaggatatcactactggctctataggcatcaaaagaataatactaaggatagtaatgaacacataaatacaaaaacttagtcaaaatagatacctacattacacctatatgatgtagattatttcaacagggctatgattattaagaaaattgaatttataattttcaatttttaaagaagtatccaggccaaattggatttgctggaaaattctatcaaacatttaaagaattaacaatgttacacaatttctactagaaaatagaagactaaacactccacaattttaggaatttaatattactctgataccaacatcagacaaagacagtacaaagatagaaaacacatatcaatatgccttataagaatggactcaacagtctctcacaaaatattagtaaatggaattagtaatatataaaaagacattcaccatgaacaagcagggatttttccatgaatgtaagcttagttccatatttgaaaatcaatcaatataatccatagtataaaccaaaaaagagaaattacattaccgtaagaaataacgtagaaaaaattgacaaatttaacacaaatttgtgataactctcagaaaatagaaattgaggggagctaccttaacacgatgaacagtatctacagaaagcctggagcttatgttatgcttgatgatataacactgtttttcccctaagatatggaatgtagcaaggatgtctactgtgaaattcttattcataatagtgttggacaatcaatacaaaagataaggaaataaaagtcctacagatgggaaaaaaagaaacaaaactgttctcaatttcagatggcatgcgtttctaggaagaaaatctcaaggaatatacaaatataaattatagaactaatatcttatctcctgcaaccttcagtaaagtcaccagatataagataaacatttagacatcatatttaaatatattagcaataaatacatgacatcagtatttaaaatgtgatattacttacaatcactaaacaaaatttgaaataactctaaatctaacaaaccatgtacagggcttgtatgcagataaatacaaaatactgatgaagcaagcaaggaagaactacataaatggaaagatatgtgtgtttagagattgaaggaatcaacatattgaagatgtaaattctccctcaagttaacatactgatttagcacagttctcatcaaaatcccagcaatactttttgacatataggtaatattattgtaaaatatatctgtataagacaaaatattagaacagctgaaacaattttggtgtgtaaaaataaagtgggaggaatcagtctatctggttttaagactgattagatagttgtagtatccaaggctgcatgaaatttttgaagagagagacacacagatcaagagaaaggatagaaaaccagaaatagacttatgcaaattctgctcaagtgatttttttttttttgcaaaagtgaaaaggaattcaaaggaaaaaagataacattttaaacaaatagtgtaggggtgactggacatccatgatgaaataaataaaagaattaatttttagaaattttgcctcacattttatacagaattaaaacaaaatgtatcatagacttaaatgtaaaatgtaacactataacattttagataaaaattcatcttcatgatatgagatcaggtgatgagttttttaatttgacaacaaaaacaggattcataaaggaaaactgattataatttgaccttatcaaaattaaacaaatttaatgtgaaaaatcctggcaagaggatgaaaatacaagccagagatgcgtagaaatacttaaaaaacacatatctaacaaatgggctagtttatagcatgtgtaaataactctcaaactccctagcataaaaagaaacaattcctgcagagtgcagtggttcacgcctgtaatcccaacactctgagagtctgaagcaggccgatcacttgaggtgaggagtttaagagcagcctagccaacatggcaaaaacccttctctactaaaaatacaaaaattagccaggcatggtggcacatgcctgtaatcccagctattcaggatgctgagggaggagaatcatttgaacccgggaggcgggggtcgcagtgagtcgagatcgtgtcacaacactccagcctgggcaacagaataagtagctggtggaattaaattgtcaatcttctcctagtaagaaagtgattgaaggtggtaacagaagaaataatcttgggagataaactgaaaatattaactgctttatgttcttagtcaaaaattcagaatttacgcagcatgctaatccctatagattttctgtttgaacaaaagtgacaatgatctaatctttaacaatactcaaaaatgttacaaaactccttttattcaaaaatctactttgcaattgtttctaaatgatttccaaaaatcctgtcagtcgttaacaagagtaaatcttaaatacacataactttatactatctccttgcattatgttctttcgatttgacattctgagtgtcagaatgatttaacttaacataaattacatcaggaatatttttatattgtacttggttgtttacatattaatgacattgacacaaaaaaatacttgttttaattcaatctttgtgaaaagacattactccaaaaggatattgaccttccacttgctatctagggtgacgtctgcagtaaagatttggggaatggccatttccttaaatgctggctggccttaatgcaccctcagatattctatgtcccataataatagccaaggtatgggaatgggatttctaatatgtagggtaagaaaggatgacaggtctgctttactagtaggagaatctcattttgggtagtggaggatataaaaggaaaattaatccagacattagaaacttggaagatttcattattgtaatgaagccaacataggaaatgtgctacattaatcctgctgaggttaaatatttctgagaaaatgtgtgtatttcaggaaaaaatcttcactgaaaatactttagagtcatttcttaattgtgcctcttctcatccattagatgggagtgaatatttaattcatttaatggattaaagtaccaataccagtaaaataccaataatctatattagggattttaaaaagtggatagtaaagttcatatgtaaaaacagataagaagagctcagaaaacactgtaagagaaatctgtgaagggggatttgccctaaaaggtaaaaacaaaccaatacaaaatctgtataataaagccagtgtggtatcagagcagaaataaacagaccagtggaatagaataggaagtctgtaaataggcttatgtgcatatgtcactttttttataagggataagtggcatttcaaatcactaacataaagatgagcatttaataaagggtgctggagcaactgggtagccatttagaaaatgataaggttagatgtacatctaacatcatagacaacaataagctccaaatggatgaggaataaaatgtaaattaaaatcataaaagtgtgaggaaaaaaagatgggtggatttgtctctgaacttggtatagggaaaatgttcctaaggataactcaaaatcagaagcaatcaaataaaagattaatgtattttactacataaaactatttaaaatgcatgccccaaagaccgcaagaacagtcaaaagataactgaaaaacagaaagtatatgtaacatacaccatggttgaagggctaacatcaccattatataaggaattcctaaatgttaagggacagagtagtaaaacttagaaaaatggaaaaccaaatattatcagacaaatgataaataaatattttaaaataaccttcaaaaaggtaaaaagtaaaaactaaatcatagtaaggaaaatgttatttaaaacaaactaagatactattttctatttattatataggtgaaaatttaaagtgtcctgttggtgagtctggagaaacaggtactctcacatattgctggtagaaatgatcatcagtctaaaagtgtaaaagggacatttgaatacacacacatacatgtatttctctcttctctctttctctcaatgatagatagatagagagatagatagatagacagatagatgaatgatagatctatattcttgctttctgaccaggaatcccacttctaggaatctaccttaaagacataccccagtaatacggaaatacataagcctaagatcatttgtgttttattcacaatcacaaaatattaaagacaacctaaatgaccatacttaggagagtggttgaataaattatggcacatctacacaaaagagtttttggcatgagggcaagctctacgcactgagccgggtccatgtataggatatgttattaagtgaaaaaagtaaaatgcaaaagaatgtttgcagtatgctacctctcatgtaaaaaaaaggagtttatatatttatatggttccatttatgtgaagtgttcaaattagtcacactgacagaataagtagatttgtagttacctagagctggagtggaggggatggggagtggatgttaaatggctacaaggccattttgggggaagatgaacatgttctaattagatcatagggatgcttagacaactctgctaatacaccaaaatccactgaattgtatagactttgcagaagtaaagttcatgacatgtagattatatagtactaataaatgttctaaaatttagaaaaaacagaggatttaagaaaacatatatgtatcagattttttgtgccaaaaaatatagggaggaaaaatcacactttaaagagattgattacctattgaggggatggaaatataggagaagagtgaaaacaaagggagaaataaatatagaatattaggaatgaaaagaaactatcacacttctgaatatacatgggatatgggatatagtttggatctttgtcttcatccaaatttcatgttgaattttcacccctaatgctggaggtaggacctggtgggaggtgtttggatcatggaggtggagccctcatggcgtgatgctgtcttcatgatagtgactgagttctcatgggatctagtggttcaaaagtgtgtggcactgccttccctaccacactctctctctctcttgctcttgctcctgctctttccatgtgacatgcctgttcccgctttgccttctgccatgattgtaagccccctgaggcctcccagaagcagaagccgctatgcatccagtggggcttgtagaaccatgagtcaatcaaacctcttttcttataatttactcagtctcaggcatttctttatagcaatacggtaatagactagtacaatatgtttgtatatttttgacttgtagaactatagtagttgttcacatacttgaaaaataaaagaataaataaaatcaaccacaatatgtgggaagtacaaaatcaaatacaaatattaaaaatgaaactagctgtattacaaacgaaaaacataagcacacaaaaatttgggaaaaagtgaactaacctaaataatttcaggaagcaatagtttttgactggatattctaatgctaaagatgaaaataattataaataaatattgagctctagttagtaaagttgtttctcagagggttatgtgtaggtgattctgaaaccatgtgtagactaggattaatcaaagaataaatgtattggaagtaattagagctaagtgtctcaatattgaagaaagaattaaaagaaagggaaggttagaaaaaacactattttggtggaatggcattatagttgtcagtatgaactcttggtttataatatacacatacataggtagatatagaaataaatatagctgtataacaatgtgtggattagtatttatatctctgtttctatctactgaatctatttctctatctctatatctatctttctatctatctacatataatctatctatttcctaggtctatatgctaaaagggcctaggaaaatgatgtcctggtagcaatgaggacaccaaacagagagctctttgtttctaagtatcattctccacttcaaaatgaagaaacaacaacaataaaccagagatttgtggagaagtggttgatctagacctagcactaggaaagtatgagatgagcctggaaattaattgttcataaagaataaggaaatgtcaaaacctgacagagatcccattggccaaaccaggcacaatctgagcaacaaaataagtactgacagtgttggattataactcataaaatagaggtccatgaattggtcataacttaactaaataatggaataaatgaataattcatcctacaaaagaattctaactaatacatatagaaggcacaagggagatacagaaatcatcattaagtaatcattaatgcaggcaagatccactgctgaatgctaatgtgagtaaacagaagtatgaggaaaagcaaaatatttgaatagtctcaaagtacctatctcaagatatgtattagttacacaaggggaaaaatagtaactttaggctgggcatggtggctcatgcctgtaatcccagcactttgggaggccaaggtggacagatcacctgaggccaggagtttgagaccagcctggcaaagatggtgaaaccccgtctctactaaaaaaatgaaaattagcagggcatggttgtgcaaacctgtaatcccaggtacttgagaggttgaggtaggcgaatcactcaaacccaggaggtgaaggctgcagtgagctgagatcatgccactgcaccccagcctgggtgacacagtgagactccatctcaaaaaacaaagtaactttatagtagagaaatacagcaaacaaaacttataagcaagtaatgatgcttaacatcaccagtaacaaaacatctatatttcacaaatcctaatatggtacactgaaaagggaacacctctgttgtattctcatatcatcatcccaaccacaagtaaataaataaaagcaagaagcataacctcaatataatcatgagaaaacatcagagaaacccaaactgagagacattttacaaaataactgaggagtacacataaaatgagtcaagtcataaaaagacaagaaaaaacctggagattgtgtcagaaattggataagactaaggagacactactaaacacaacatggggtattgatttatatcctgaaacatgagaagatcttagtggaaaaagtggtaaaattcaaataagacattgcagtgggataattaaggaatcagagagaccgaggggttgaggaggaattatttaattatttatgtgcaacaactcagttggattaacatccaaaggactgagccccaaacaaagagtccggttaccttttaagcattttggggtggtggtggtgggagatctgtgcagggggaagcatattacagaagtgagaaacaaagacagttattcaattaagacatgcattacatcatttcttacttttcaaggaatagcatgttttacgacttgagtttatctgcctagtgaccttgcagctgcacagctagagaaacaaggtcttcacaatgcctgggaaggggagagataaggctcactagccacagaaaagcaggcagttaattttaaaggactccagctctttctcttcttcagggggaattgggttttcttacatacaactgagtttttgcttacattctttaatttgttttaattcctgttccaacatgttacttggtcaatactgctgaaccaatttaattttcctaaatgtatctttgttatgtaagttgctaccatgaggagcagtgaggtgaggggtacacatgaattctccttattaactttgcaacttttctgtaaacataatattatttcaaaataataataataagaagaatgaggtgctttttacattttggagattcaaaagttgagcaaagaaaagggaatgcaaactgcccaagctgaaacagttgtccatccgtgatttaaaatccaaaagcctgaattcaaaagccattgtcctaaaacattcacacaatgtttagaatgatgaaggcactcaataactgaaggcatttataaattccaatacctcaaactacatagaaatttcatatgaaccggagagcagttttcactgggtgtcagtggaaatgcagtgagaggttttgtggtggtccaaaattacttgaagcattggcagtgggaaagggtcaagaatgtgaatagctcttcagagcatggaaagatgagcataacaacaataaacacatctaaagaccaattgtgaattgtgaatcaccaactggggaacactgaggaaccaagaaaggcattctaaatctgaaaaagttgagtttgtttattagatcaacacagacaaatatgtgtagtgtttccaaaggtagactagcaaggtgctgtcttcttgctgaactttaaagctaattgtcagatgctaaagtttggagtatataatttgtattcaatttagttacatgtttggagaaaagattgtcaattattatgattattccttagtatttaataaaataataggtgatacttttatttggcccatatttgtatattaaaattagacatctataattgaatcagacctcaaacctatattttgattatttaatctaaatgttttccaatcggaaaatgttactttttcttctcatcttatagcacatggaaaaagcaccacactaccctgacaaagacgagaaaaggaactcaaggtgcctcagtgatgcagaatgttatcttcatgcaatcaggttcccttcgcaggtgtgctgtttgtgggattcactgtcagctcccattaattgtatctcctatattccttgtagatggttccctcaatggtgacagcttgttttagcagtagtcctattaacagcgactctcacaagaaatatcctcttcaattgaaatggcttccattcagaacaactcttagttttggcattctgttctatccataatgaatatagctttccccaactagcactccaagcaacatgtgtcatatctccagtgtctctcacctccttacacatgcctaatttcttcacagttaactctcgctactccaaatggatactgtagagtcttttagaaatgcagaatctcaggctctatgctagatttgctaaatcagagactgcattttaacaagatccccacatgatttatttgaccatcagtttaagatgcactgacctaggtgaatcagtgtggcagttttagtaccatattcaaaggccagctcatattggggtccctgaaaagtttttcagcgacagcctgctgcaaaacttctacaaactatgcagaaagactctagactaaccagatattcaaaaaaatgttctaatcaaaattccttacatgtcatttaaaacttgatttttaggccattatgtaaatacctatgattttactttttgtaaaaaaattctgaaagatgccatcacaaaatgtgtttgcttgcactagacaataagctctttcaagaccagtgtacatgagttactgagatagctgaatataaaatactgatttggaaggaccttcaaagattttgttatatattgcttccactttctgaagatgttttaatacttagtgggcatttggaaaagaccttcaaatagtcacctcactcaattattaattatttaatgtacacaacagatttacttccagtcagccatgcttttattatctccttaaaaatattattctatattatccagaatatttgattcttctcatagacatattttaaatctttaagactgtgaattcaattgaagtctatccaattggaataataattaggatttctccttaagaaacttacgcatgagaggtggagccaagatggctgaataggaacaactctagtctataactcccagcatgagtgacacagaagacgggtgatttctgcatttccaattgaggtactaggttcatctcactggggagtgttggaaagtgggtgcaggatattgggtggagtgcactgagcatgagccaaaggcattgcctcagccaggaagtgcaaggggtcagggaattcccattcctattcaaagaaaggggtgacagatggcacctggaaaattgggtcactcccatcccaatattacacttttccagcagtcttatcaaatggcacaccaggagattatatcctgtgcctggctcagagggtcctacgcccatggagcctcattcattgagagcacagcagtctgagatcaaactacaaggtggcagcgacactgggggaggggtgcccacaattgctgaggcttgagtaggtaaacaaagggccaggaaactcgaattgggtggagcccatcacagctcaaggaggccagcctgcctctgtagcctccacctctgggggcagggcattgccaaacaaaaggcagcagaatcctctgcaacttaaatgtccctgtctgacagttttgaagagagtagtggttctctcagcatgcagctggaaatcagagaatggacagactgcctcctcaagtgggtccctgacccccaagtaacctaactgggaggcaccccccagtaggggcagactgacacttcacacagccggttactcctctgagacaaaacttccagaggaatgatcaggcagcaacatttgctgttcaccaatatccgctgttctgcagcctctgctactgatatccaggcaaacagagtctggagtggacgtccagcaaactccaagagacctgcagctgagggtcctgaatgttagaatgaaaactaacaaacagaaaagacatccacaccaaaaccccatctgtacatcaccatcatcaaagaccaaaggtagataaaagcacaaagatggggaaaaaacagaggagaaaaactggaaactctaaaaatcgagtgcctctcctcctccaaaggaacacagctcctcaccagcaatggaacaaagttggatggagaatgactttgacgaattgagagaagaaggcttcagatgatcaaactactttgagcaaaaggaggaagttcaaacccaccaggaagaagttaaaaaccttgaaaaaaaattagacaaatggctaactagaataaccaaggcagagacgtccttaaatgacctgatggagctgaaaaccaaggcaagagaactacgtgaagaatgcacaagcctcagtagccaattcgatcaactggaagaaagggtatcagtgatgaaagatcaaatgaatgaaatgaaacaagaagagaagtttagagaaaaaagaataaaaagaaatgaacaaagcctccaagaaatatgggactatgtcaaaagaccaaatctacatctgattggtgtacctgaaagtgacgggaagaatagaaccaagttggaaaacactctgcaggatattatccaggagaacttccccaatctagcaaggcaggccaacattcacattcaggaaatacagagaatgccacaaagatactcctcgagaaagacaactccaagacacataattgtcagattcaccaaagttgaaatgaaggaaaaaatgttaacggcagacagagagaaaggtcaggttacccacaaagggaagaccatcagactaacagctgatctctcagcagaaactctacaagccagaagatagtgggggccaatattcaacattcttaaagaaaagaattttcaacccagaatttcatatccagccaaactaagcttcataagtgaaggagaaataaaaccctttacagacaagcaaacgctgagagattttgtcaccaccaggcctgccctaaaagagctcgtgaaggaagcactaaacatgcaaatgaacaactggtagcagccactgcaaaaacatgccaaattgtaaagaccatcaaggccaggaagaaactgcatgaactaatgagcaaaataaccagctaacatcataatggttattttattggatcaaattcacacataacaatattaaccttaaatgtaaatgggctaaatgctccaatgaaaaggcacagactgacaaattggataaagagtcaagacccatcagtgtgctgtattcaggaaatgcaactcacatgcagagataacacataggctcaaaataaagggatggaagaagatctaccaagcaagtggaatacaaaaaatggcaggggttgcaatcctagtctctcataaaacagactttaaaccaacaaagatcaaaagagacaaagaaggccattacataatggtaaagggatcaattcaacaagaagacctaactatcctaaatatatatgcacccaatacaggagcactcagattcataaagcaagtccttagagacttagactcccacacaataataatgggagactttaacactcactgtcaacattagacagatcaatgagacagaaagttaacaatgatatccagtaattgaactcagctctccaccaagtggacctaatagacatctacagaactctgcaccccaaatcaacagaatatacattcatctcagcaccacctcacacttattccaaaattgaccacatagttggaagtaaagcacccctcagcaaatgtaaaagaacagaaattataaaaaactgtctctcagaccacagtgcaatcaaattagaactcaggattaagaaactcactcaaaaccactcaactacatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgtccaaaagagaaagcaggaaagatctaaaattgacaccctaacaacatcattaaacgaactagagaagcaagagcaaacacattcaaaagctagcagaaggcaagaaataactaagatcagagcagaactgaaagaaatagagatgcaaaaaacccttcaaaaaatcagggaatcccagagctggttttttgaaaagatcaaaaaaattgatagaccactagcaagactaataaagaaaaaaagagagaagaatcaaatagatgcattaaaaaatgataaaggggatatcaccaccaatcccacagaaatacaaactaccatcggagaataacataaacacctctatgcaaataaactagaaaatctagaagaaatggataaattcctcaacacatacaccctcccaagtctaaaccagcaagaagttgaatccctgaatagaccaataacaggctctcaaattgaggcaaaaattagtagcttaccaaccagaaaaagtccaggactagatggattcacagctgaattctaccagaggtacaacgaggagatggtagcattccttctgaaactattccaatcattagaaaaagagggtatcctccctaactcattttatgaggtcagcatcatcctgataccaaagcctgatagagacacaacaaaaaaagagaattttagaccaatatccctgatgaacatcgatgcaaaaatcctcaataaaatacaggaaaccgaatccagcagcacatcaaaaagcttatccaccatgatcaagtgggcttcatccctgcgatgcaaggctggttcaacatacagaaatcaataaacataatccagcatataaacagaaccaatgacaaaaaccatatgattatctcaatagatgcagaaaaggcatttgacaaaattcaataactcttcatgctaaaaactctcaataaattagtaggtattgatgggacatatctcaaaataataagagctatctatgacaaacccacagccaatatcatactgaatgggcaaaaactggaggcattccctttgaaaactggcacaagacagggatgccctctctcaccactcctattcaacatagtgttggaagttctggccggggcaatcaggcaggagaaggaaataaagggtattcaatttggaaagaggaagccaaattgtccctgtttgcagatgacatgattgtatatctagaaaaccccattgtctcagcccaaaatctccttaagctgataggcaacttcagcaatgtctcaggatacaaaatcaacgtgcaaaaatcacaagcattcttatacaccaacaacagacaaacagagagccaaatcatgagtgaactcccattcacaattgcttcaaagagaataaaattcttaggaatccaacttacaagggacatgaaggacctcttcaaggagaactacaaaccactgctcaatgaaatgaaagcggatacaaacaaatggaagaatattccatgctcatgggtaggaagaatcaaaatcctgaaaatggccatactgcccaaggtaatttatagattcaatgccatccccatcaagctaccaatgactttcttcacagaattggaaaaaactattttaaagttcatatggaaccaaaaaagagcgcacattgctaagtcaatccaaagccaaagaacaaagctggaggcatcacactacctgacttcaaactatactacaaggctacagtaaccaaaacagcatggtactggtaccaaaacagagatatagaacaatggaacagaacagagccctcagaaataatgctgcacatctacaactatctgatctttgacaaacctgagaaaaacaagcaatggggaaaggattccctatttaataaatggtgccgggaaaactggctagccatatgtagaaagctgaaactggatcccttccttaaaccttatacaaaaattaattcaagatggattaaagacttaagtgttagacctaaaaccataaaaaccctggaagaaaatgtagacaataccattcaggacataggcatgggcaagaactttatgtctaaaacaccaaaagcaatgacaacacaagccaaaattgatgaatgggatctaattaaactaaagagcttctgcacagcaaaagaaactaccatcagagtgaacaagcaacctacggaatgggagaaaatttttgccatctactcttctgacaaagggctaatatccaaaatctacaatgaactcaaacaaatttacaggaaaaaacaaccctatcaaaaagtgagcgaaggatattaacagccacctctcaaaagaagacatttatgcagccaacagactcatgaaaaaatgctcatcatcactggccatcagagaaatgcaaatcacaaccacaatgagataccatctcacaccagttagaatggtgatcatcaaaaagtcaggaaacaacaggtgctggagaggatgtggagaaataggaacacttttaccctgttggtgggactgtaaactagttcaaccattgtggaagtcagtgtggcaattcctcagggatctagaactagaaatgccatttgacccagccatcccattactgagcatatacccaaaggactataaatcatgctgctataacgacacatgcacacgtatgtttattgaggcactattctcaatagcaaagacttggaaccaacccaaatgtccaacaatgatagactggattaagaaactgtggcacgtatacaccatggaatactatgcagccataaaaaatggggagttcatgtccttttagggacacggatgaagctggaaaccatcatcctcagcaaactattgcaaggacgaaaaaccaaacaccgcatgttctcactcataagtgggaatcgaacaatgagaacacatgaacacaggaaggggaacatcacacaccggggcctgttgtggggtggggggagggggagggatagcattaggagatatacctaatgttaaatgacgaattactgggtgcagcacaccaacatggcacatgtatacatatgtaactaacctgcacgttatgcacatgtaccctaaaacttaaagtataataaaaaaaattatccaccaggcgtggtggctcatgcctgtaatcccagcactttgggaggctaaggcaggcggatcatgaggtcaggagtttgagaccagcctgtccaatatgatgaaaccccgtctcttctaaaaatacaaaaattagttgggcatcatggcaattgcctgtaattccagctattcaggagcctgagtcaggagaatcacttgaacccaggaggcagagattgtagtgaactgagattgtgccactgcactccagcctgggtgacagaatgacactctgtctcaaaaaaaaattgttaaattttcgtaacaacctattgaaataaggcagcaaaatcctcactttgtagaagaagacattgagcctatgagaagtaggttctccaagaacaaatagctgttcattatggagctaggccttatgcagagttgggacactttctattatgtcaagctaaggcaagttaatttactgagtcacagtgccctcgatttatgagtatttcacctttttttctctttaattagaagcttattgagaagcttgtggaatgtaggcgtaagtgtattggataattaaagttttgatattctgatattgttggaactacttgaagaatttaacatttggtaagtatttttcatatgagtattaaaatagtaattttacttattatatgtttatacatagaatttgtcaattactttctgactacaaagacaaacagatacaaaaaagccgttctctcaacagcaatccaagtaagacttctgacagtgaattactctaggtcagtggttcccactctttttggcaccagggaccggttttgtggacgacaatttttccatggactggaggaaggaggggatggtcttgggatgattccagcacattacatttattgtgctactttatattattatattgtaatatataatgaaataatgatacaactctccataatgtagagttagtgagatccctgaacttgttttcctgtcactggatgttctcatctggaggcaatgggagaaagtgacagatcatcaggcattggattctcataagaagcacacaacctagatccctagcatgtacagtttatagcagggttcatgctccaatgagtatctaattctacctctgatctgacaggaggtggagctcaagtgggaataggagaaatggggtgtggctgtatatacagataaagctttgctggcttacctgccactcacctcttgctgtgtggcctggttcctaacaggccatgggctggtaccagtttgttgcccaggagttgtggacccctgcgctaggtggtcctaccatagataagaaagtaaaagtaaggaagtttttatcacaaaaaaaaaacagtttgaaaaatcactgtgtataaattgcatgtatatattttacaattttttttgagagtaggttcgatttcagaattatttaaaaatttcattttaggtgatttataatttcaaatatctgaaaaatttaattatggtctctaaaatcttgtataatatttttatgtaaataagaaaaacacaagttagtacatggtatatcttttttacggtcacatgataacaaattggacttgttatacaattgaatcttctatttaattatttaaataaatggtttgctttgagcaaatgaatgttaattacagttgacccttgaacagtgtaggacttaggggtaccaatcctccatgcagccaaaaatctatgtataacttttgacttccctcataacttaactactaatagcctactgttgaccagaagccttattggtaacacagtcagttaagatgatatttggtgtgttataagtattgtatgttgtatttgtacaataaactggagaaaagaaactgtcgggaagaaaaaatataattaatatcaagtggaagtggatcatcataaatgtcttcatccttaatcttcaagttgaataggctgaagaggagaaagagggaggttgggcttgctgtctgaggtgacagaggtagaagaaaatctgcatatgagtagtagacccctacagttcaagcctgtgttggtcaaaggttagctatattacactgaggtttgtgtcactaaaaaagtaactatctttaaaagtggaaactcagcaatacctttctaataccataagcaaatgagaatgagaactgcaagacttagtcagtgtgcagcaacaccaatgagaaattattttttttaaagatacctacagaagtgtccctgtctgacagctttgaagagagcagtggttttcccagcatgcagctggagatctgagaatgggcagactgcctcctcaagtgggtacctgacccctgacccctgagcagcctaactgggaggcaccccccagcaggggcagactgacatctcacacatctggccaggtactccaacagacctgcagctgagggtcttgtgtgttagaaggaaaactaacgaacagaaaggacatccacaccaaaaacccatctgtacatcaccatcatcaaagaccaaaagtagataaaaccacaaagatggggaaaaaacagagcagaaaaactggaaactctaaaaagcagagtgcctctccacctccaaaggaacgcagttcctcaccagcaatggaacaaatctggacggagaatgactttgacgagctgagagaagaaagcttcagatgatcaaattactccaagctacgggaggacattcaaatcaaaggcaaagaagctgaaaactttgaaaaaaatttaggagaatgtataactagaataaccaatacagagaagtgcttaaaggagctgatggagctgaaaaccaaggctcgagaactacctgaagaatgcagaagcctcaggagccaatgcaatcaactggaagaaagggtatcagcgatggaagatgaaatgaatgaaatgaagtgagaagggaagtttagagaaaaaaacaataaaaagaaacgagcaaagcctccaagaaatatgggactatgtcaaaagaccaaatctacatctgattggtgtacctgaaagtgacggagagaatggaaccaagttggaaaacactctgaagaatattatccaggagaacttccccaatctagcaaggcaggccaacattcacattcaggaaatacggagaatgccgcaaagatactccttgagaagagcaactccaagacacataattgtcagattcaccaaagttgaaatgaaggaaaaaatgttaaaggcagccaaggagataggtcgggttacccacaaagggaagcccatcagactaacagcggatctctcagcagaaattctacaagccagaagagagtgggggccaatattcaacattcttaaagaaaagaattttcaatccagaatttcatatccagccaaactaatcttcataagtgaaggagaaataaaatactttacagacaagcaaatgctgagagatttcgtcaccaccaggcctgtcctaaaagtgctcttgaaggaagcactaaacatggaaaggaacaaccggtaccagccactgcaaaatcatgccaaaatgtaaagaccatcgatgctaggaagaaactgcatgaactaatgagcaaaataaccagctaacatcataatggcaggatcaaattcacacataacaatattaactttaaatgtaaatggactaaatgctccaattaaaagacacagactggcaaattggataaggagtcaagacccatcagtgtgctgtattcaggaaacccatctcacgtgcagagacacatataggctcaaaataaaaggatggaggaagatctatcaagcaaatggaaaacaaaaaaaggcaggggttgcaatcctagtctctgataaaacagacattaaaccaacaatgatcaaaagagacaaagaaggccattacataatggtaaagggatcaattcaacaagaagagctaactatcctaaatatatatgcacccaatactggagcaccccaattcataaagcaagttctgagtgacctacaaagagacttacactcccacacattaataatgggagactttaacaccccactgtcaacattagacagatcattgagacagaaagtcaataaggatacccaggaattgaactcagctctgcacccagtggacctaatagacatctacagaactctccaccccaaatcaacagagtatacattttttcagcaccacaccacacctattccaaaattgaccacatacttggaagtaaaactctcctcagcaaatgtaaaagaacagaaattataacaaactgtctctcagaccacagtgcaatcaaactagaactcaggattaagaatctcattcaaaaacgctcaactacatggaaactgaacaacctgctcctgaatgactactgggtacataacgaaataaaggcagaaataaagatgttctttgaaaccaacgagaacaaagacacaacataccagaatctctgggacgcactcaaagcagtgtgtagagggaaatttatagcactaaatgcccacaagggaaagcaggaaagattgaaaattgacaccctaacatcacaattaaaagaactagaaaagcaagagcaaacacattcaaaagctagcagaaggcaagaaataactaaaatcagagcagaactgaaggaaatagagacacaaaaaactcttcaaaaaattaatgaatccaggagctggttttttgaaaggatcaacaaaattgatagaccgctagcaagactaataagaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacagacactctcccaagactaaagcaggaagaagttgaatctctgaatagaccaataacaggatctgaaattgtggcaataatcaatagcttaccaaccaaaaagagtccaggaccagatggattcacagccaaattctaccagaggtacaaggaggaactggtaccattccttctgaaactattccaatcaatagaaaaagagggaatcctccctaactcattttatgaggccagcatcatcctgataccaaagccgggtggaggcacaaccaaaaaaagaattttagaccaatatccttgatgaacattgatgcaaaaatcctcaataaaatactggcaaaccaaatccagcagcacatcaaaaagcttatccaccatgatcaagtgggcttcatcctgggatgcaaggctggttcaatatacacaaatgaataaatgtaatccagcatataaacagaaccaaagacaaaaaccacatgattatctcaatagatgcagaaaaggccttagacaaaattcaacaaccttcatgataagaactgtcaataaattgggtattgatgggacgtatctcaaaataataagagctatctatgacaaacccacagccaatatcatactcaataaattaggtagtgatgggacgtatttcaaaataataagagctgtctatgacaaacccacagccgatatcatactgaatgggcaaaaactggaagcattccctttgaaaactggcacaagacagggatgccctctctcaccactcctattcaacatagtgttggaagttctggccagggcaattaggcaggagaaggaaataacgggtattcaattaggaaaagaggaagtcaaattgtccctgtttacagttgacatgattgtatatctagaaaaccccattgtctcagctcaaaatctccttaagctgataagcaacttcagcaaagtctcaggatacaaaatcaatgtacaaaaatcacaagcattcttatacaccaacaacagacagacagagagccaaatcatgagtgaactcccattcataattgcttcaaagaaaataaaatacctaggaatccaacttacaagggatgtgaaggacctcttcaaggagaactacaaaccactgctcaatgaaataaaagaggacacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccacatcaccaagtcaatccaaagccaaaagaacaaagctggaggcatcacactacctgacttcaaactatactacaaggctacagtaaccaaaacagagatatagaccaatggaacagaacagagccctcagaaagaatgccgcatatctacaactatctgatctttgacaaacctgagaaaaacaagcaatggggaaatgattccctatttaataaatggtgctgggaaaactggctagccatatggagaaagctgaaactggatcccttccttacaccttatacaaaaatcaattcaagatggattaaagacttaaacgttagacctaaaaccataaataccctagaagaaagcctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtggacaggaaacctacaaaatgggagaaaattttcacaatctactcctctgacaaagggctaatatccagaatctacaatgaactccaacaaatttacaagaaagaaacaaagaaccccatcaaaaagtgggtaaaggatatgaacagacacttctcaaaagaagacatttatgcagccaacagacacatgaaaaaatgctcatcgttactgtccatcagagaaatacaaatcaaaaccacaatgtgatatcatctcacaccagttagaatggcaatcattaaaaagtcaggaaacaacaggtgctggagaggatgtggagaaataggaacacttttaccctgttggtgggactgtaaactagttcaacctttgtggaagacaatgtggcaattcctcagggatctagaactagaaataccatttgacccagccatcccattactgggtatatacccaaaggaatatgaatcatgctgctataaagacacatacactcatatgtttattgcagcactattcacaatagcaaagacctggaaccaacccaaatgtccaatgatagactggattaagaaaatgtggcacatatataccatggaatactatgcagccataaaaaatgatgagttcatgtcctttgtagggacatggatgaaattcgaaatcatcattctcagcaaactttctcaagaacaaaaaaccaaacaccgcatattctcactcataggtgggaattgaacaatgagaacacatggacacaggaaggggaacatcacactctggggactgttgtggggtgggggaaggggggagggatagcattgggagatatacctaatgctagatgatgagttaatgggtgcagcacaccagtatggcacatgtatacatatgtaactaacctgcacattgtgcacatgtaccctaaaacttaaagtataataataataaaaaaaaccagctaaaggaaaagaaatattttgagaacactgaaaatatgaaaaaaagaatgataatcttctaaaagctataaaattgaatgaggaaactttaacaaaagaggtatttcactacaatgaacagcttagcattttgacaactgagaataaaatgcttggttttaaactgggggatataaagcaccacaaggaaagactggaaacagaaattcaatcatataattgtagactggccactgctgtatatttttgtgaccaaagtgagaaagcaaaaagagacctctttccagagaataagacacaaataggttcatttacaggagaaaatgaagtttgatatgcctaccctaaaaggtaacagtgaggttctttctgaacaactctctaatgctgacagtaaaattaacagcctaaaaattaagctccatcacacaagataaacactcggagaaaagacttcagttttagaacatttccaaagagatctatgccaaacacagacagtgtcaaaagaaagaaattgaacaaatgtgtcaaaatgaacaaagcagagtaaataaatatactggagtgcagaaacctatgaagacagattttctcaactacaaagtgaaaataatttgctttggcagcaactggatgatgctgacaagaaagctgagagtcaagaaaagacaatcagtactatccaagagcaattccatgctgttgtcagaaatcttctagctgagagtataaagtcttctgctggaagaggaaaacgaggagataatcaatgtacgtaatcccttgaaagaaagaatatatcaatgtgaaaaagagacagtgggaaaaaagtaagtattaacaaagatatttttcaaacttcctgaaagaaaatttaaagtaatatttggttatggtaaatgttatatgtatttgaatataaaaatatgtagaccataaaatatatttgctgtacggcctagaaacataccagcaaaaaaaggtagacctgaaatttgccttattttgaacaacgaaattgtatcacctttgaaattttaagactttattttacaaatttactatatatagactaatagttctaatgtggacttctgctgaaataattttaatatctctctgtggactaattttaagaccatgatgagacagataaacagaaatgccttttacctgaaatgaattttttgaaattaagattcaatcatgtgggttactttgacagttatttccagatttcccaggtgaactgaaatatactgctgtatctcatagtacttttttaaggtagctttttatgtatttatgttggtgtagttttatttttatttttactgatttgacttaaatctgagactttaagtctcacattattgttatgacctctcaattatttgaaggcatttactttttataaaatcattatttggaacagatgtgaatttccagcaaaaccatatttgatttagtcgtacctctggtgtttataattttaatgttcttaaaagtaatttgctcatgatttttatcttatggctcaatgactgtcatttggctataaccttgtccagtacaaagataattgtgtttgtctgcagttgctttgtttagcattgggttttcattttaaagctaatgagggatggcagaattcacatacagttggaatggaatgagtaggggagagagttataggaactgaggtaagggagggaggtggaggccaggttacctagggcctccaaatgtcattggaattttacttttattctgaggtagaaatctattagaaggatctgagcaggcaattgaatatgtgaggagtggggaggtttatttgaggttctgataaaaaagaggaaagacattttacactccagcattttccaccactagtgccacccacataccgaatttttgggacttcagtaggttgttaagcattgtaaatgtatcaggggttaatgaatagtgggctgattctgtcatctagcagaatactcatttggaaggaatataacacctgtgtccttaactgaattcagtaataagaatgtatacacatgaggaaaagaaggtgaatccatgtatgtggtgctatttttcaaagtatatgttgaatgttatgatcatgttttaataataaggtgatatatgaaatcagtaacaaaaatatcttaacaggtaattatgagacaacttctacaagaaccggctgataccctgaaaaaaaacctgtcagagccttccctagaggctacaccacattgtcacattaatttagaagagacacaagattcaaagaaggaattaggtaaaatcagagtcaagtatgtatgaaatgtaacatgtcaacagttaatctgtaggtggtggaggaatatatagttttaggatgctaattgcagtggatagatttcttttgtattttcattacaattaattttattatctttatcatgcacttatttcttctgacttttcagtctgtcatgtttttctcataagtatgtacattttaaagataatatttacccttaagaaagctgggaattatacatcattcctcacagaagttgagagacttttttttgtgtgtgaaacagtatttttcagggatttctctgttgccatgttgaggcaagccagattacatcagaggataatgttcaatagaatgttccagaaaagcatcttattgcttatcttactttcttggatgggtgcagaatctttgtatatttattgcatgaattttaggataacttgtacagaaaggccattatacttttctccaaaatgcagatgttttaggttaatttacaaagtacttgaaatgttaagcattcccttcttttttctttcattttaagtatattgtaaaagcatggaaatgctcagtttgtgtagagtatatacatccaaattagaggattaagaaacgtatctagatcctaccattgggattttaaaagacaattgtagtgatgtataatttgaacaccatacagttcacatggtctcttagtatattcacagagttgtatagccatcaccatcaccaattttagaatattttcatgatcctaaaaagaaacagtgcatcattttgctattatccaccagtttgcccttcctcagctctagggaaccaccagcctactttgtctttatagagttgcctattctggacatttcatatcagttgaaccacacaatatgtggtggtcttttgtgattgggttctttcacataggataaggttttaaggctcatctgtgttgtaacatatatcagtactcaattccctcttattgctgagtaatattccactgtgtggatatatcagtcattttatttactcattcctcagttgtggacctttgaattgtttccattctttggctattaatcatgtctgcttttatgtacaagtttttgtgttttcatttctcttgggtgtatgcatacaagtggaattgctgggtcatattgtaactctatatgtaacattttgaggagctgccagtctgttttccagagtggctgtatcattttacattcctatcagaattgtgtaagggttccaacttctctatttctttgccaacatttttcacatttttgattaagaaaagatttcctcttagtggtgtgaaatgatacctcattctggttcgatttgcatttccataattccctatgatacctcattttggttcgatttgcatttccctaatgactaattactttaatcatctttttacgtgcttcggagtgacttgtgtatcttctttggagaaatgtctattaaaatgcagcctatttttaaaagtggttgcctttttgtttgtgaatccataagatccttaacagatatgattctcaagtattttctttcactcaataggcttttttaaaactttcttgatgatgtctgttcacgtgcagacatttcaaattttgatagtcattaatctttttttgcagtcacaaagatttatgtctatgctttcttctaaaaattttatagttttagctcttatatttagtgattctattttgagttaattttagatacagcatatgccaggagtctatttttattcttttgcatgtagatacctagttttcccagcaccatttgtggaaaagactattcttttaaataaattaatattcttttttaagtgttgttctttttggcacccttgttgaaaatcaattgaccataaatgtgagtttatttttggattctcaattctaatatgttgatttatgtctactgttatgccattaccaaagcaaattttagaattgttttccaatcgtgttacttattattaccaattgcctaaagtaagaatagaaattcaagtactaggtagcctttaacttcactgtttgcttcttgaaggaacatgtggtcagcttatattatggtaacttcatgcttaaccttttgaggagctgccagtttgttttccaaagtggctgcaccactttacatttccagcagcattgtataagggctttaatttctttacatttttgctaatatttatattttcctaatgactaattacattaagcatcgattaatgtgcttatatccatcttttcttctttgcaaaatttctattcaaaatctttgcccatttttaattgggtcatctttttatttatgaattgaaagggttctttatatatcctagatataagtcccttatcagatatatgctttccaaatattttcttctactcgttgacttgacttttcactttcttgactgttttctcacacacagaatttttcagttttgaagtccattgaatccatttttcctttggagtcagagctaagaaaacactgccaaatgtagttacaaagacttatgccaatgttttcttctgaaagttttagagttttagctgttacagttagctgttttattttgagttaattattaaatatggtatttagtgagagtccaactttattatgtttttgcatatggatacccagttgtcccagcaccatttgtctaaaagactattcttttcccatttcattgttttgttaaccctgtaaaaaatcaattgactgaatacgcaggtttattttttaatgatcagttctttgtttatgtctattcttatgccagggccaaattgaatttaataagtttttttcaatcatgttgcatattaccagttgtcttatgtcataataaatattaaatatagtggaacatctttaacttcaccttctgcatctccagagagtctgtggtcagcttatactttacttatcctaagacatgatgagaagtcaggcttacaagacacaattcatttctttttttttcctccattcaagcctttagtgtcttatccagtgcctccctctatagtttcattttcagtaaattttggtcgcaggatccgctgacatagcctactatttagtgcattatgtcttattaactcattataattcatagaatcatccatagatgcttaccatctagaaaggagaagtttaagtctgagctgccagctttcctcagtggaagtcaagtgaagttatcatctttcaattcgcagatcctttttccacctggtagctggttctcttgtgtagcactgtggctgatccttttcttggtgcagatcctgcattctcagaaaccacagttccctgtattgacctcgttttactgaaacagagatgcacagctgtgctttgtagcttagtagaagattcttggagtaaaaagtttaactcattgcaagaaaaatatttaggagtgcagcgcttaaaaatctggtaatgttcaggaaatttatcagtagtagattagtaatttgaattttaaaatttcagagtcaacttgtgtgctatagagaagcgttgtggtataacatagagatgggatggtcttaacttctccatacaaacaagcttgaagtaaggatgaaggagaaatcgcatttgatttcttaacactcaaggcacactacatttattttacttctgtgaagattaaaaataattccatcgtgttctccttgtttccccactgagtaaaggaaaatgaaaatggaatactagattgattaataaatactcaaagctgcttacttttagaatttttagttaattgaaatcaggtaaactgtctgattttggttatttaaccaagtagttctagttgtttttaaaaatcacgtcttcttgctttccagtcttatttcctaacttgaggggaaattctaaggagacacccttgccttgtcatcagagttcataattgaagggagttttaggaaaagttcatcctcaggaacttatgtctctctcccagttatctgctgcttctcaataatgcttgtcatcaataaattaatctcaacatttatttgattctactttaaaagagactcttttctgctgtgtaagttatgtttcctgttgtctcttttttaaaatcatttttttctaacaattacccagagtttagtggcgtaaaagagaaacatttaaggctgggcacggtggctcatgcttgtaatcccagcactttgtgaggcagaggtgggtggatcatgaggtcaggagttcaagaccagcctggccaagatggtgaaaccccgtctctaataaaaatactaaaaaaagaacaacatttattttgctcatgaatctgtggcttggaaaaagcttggccaggacagcttgtctctgcttccctcagcttccctaggaacagctgaatgactggggaaatggaatcatcagatgctttgttcaaccatgtgtttgatggttaatgctggccattggctggaaccttggtttgggcaggcagcatgaacactgacactggcactcccaggctctctttgtggcctgagctctctcttagtctgggggctgggtttgaagggaaagcagttggagatagagaagccacatggaatcccttattactgcattcttttcattagaaggaagtcagtaaggttggcccgtattctatttttttagtgggatgaatttatcttctcttttgtttttaattgacatgtatatacaaaattatgagttataaagttatattttgatacatgtatatagtgtgtattgatcaaggtattactagcatatttattacctcaatcatttttcaaaaagtcttccagctttttgaaaatatacaataaatcatagttaagcatattcaccctacaatgctacaggacgccagaactcattccttttttataactgtaattctgtatctattaaccagcctcccctcccttacttccttgagttttttgttgttgttaagagacagggtcttgctagtctagtctgggccctgggcaactgcagtcactcagactagagacaatgatttgatcatagctcactgcagcctcaaactcttgggctcatatgatcaccccaccttagcctcctgagcagccaggattacgggtgtgcaccactgcacctgtctgattttttactttgtagacatgaggtctcatgatgttgcccaggctggtctggaacttttggcctcaagcagttctcctgccttggtcttttaaagtgctaggaaattgcaggcatgagccatgttgtccagccttcaatttttctttagctcccacacatgagtgagaatgtgcagtatttttctttctgtgcctgcacttaacattctccagactcatccacgtggcaacaaataacaagatttcattcctctatatgtggaatactattccattttgtatgtatactacattttttgtccatttgttgatggacatataggttgattccatacattagctgttgtaaatagtgctacaataaatgtacgagtacagttatccttttgatcttttgttttcgattggctgaatactcagtagtgggtttgctggatccctcagcagttccaatactagttttttgagaaatcctcatgttgttttctgtagtggctgcactaatttaccttcctatcaccagcatataagagtttactgttctctgaaaccttacctgcatttgttattttttgtcttttcaatgatagtcatttatttgaactggagtgagattatacctcgttgtaggtttgatttgtgtttccctgatgattagtgatactgagcatttttaaatgtatttatttgccatgtgtatttctttttttgaaaaagaaatgtgtattcagatcttttgccttattttgaattcagattttttttaatgtcaagtgtttgcgttcttgtatattttggatattagtcctttattagatgaatagtttgaaagtattttctcccattctacaggttttctgtttactcagttgttttctgggcaaaagctctttagcttaatgtggtaccatttgtctatcatttgttttttgcctatgcttctgatgtcttatccataaaaatctttgtgcagactaatgtcctgaagcatttttcctatatttactgctagtagtttgataattttgggcctgacatttaagtcttcaattcattctgagtttattttggtattggtgttagataggaatctattatcattgttctccatatgtatattcagttttcccagtggcattcatttgaagagggtgtcctttccccaatgtatgttcttggcatcttagtccaaaatcagctggctgtaaatatgtggatttatttctgggtggcatgtgccatagactttaccccaagaatcattacttcttaaaatgcaattcaaattagcataaaacatttgcattttagggaaaggcttatgacattagaatccttatttacaggattcattattttgtctcttttttttgagatatggtctttgtctgttatccaggcagaagtgcagtggtgtggtcataattcactgcagccctgaactctgtgtccaagccacccttttgcctcattctcccaatgagctggatgtacaaggcatgaataattaaaaataatttttttttgtagagatgtggagtctcactgtgtttctgtggctgctctcaaattcctggcctcaagtgatctttctgccacagactcctaaactgctaggattacaggcatgagccaccatgcctagcatagagtgttatattattttcagtgtcttattctgagagccattttttgactttggcctaaatatcttaatatgatatctctgaaactttttttgacaaattatggggaatgatgatgagggaagaggtttataaactttctcctaagagataacttagagccatttaaggaggaacaaaaagaaacaatcagaataataaaagatcaagtgcaaaatttctgcatcaaagatgatgatagtaaagaatatatttttgtgactcatggtggtctaattttgttcttgaatttctgagtaatttaagggttaacatttgaggaatctgctacattacaggtaatattttattccaagtaaatgtatttcaaaaattttattggtttattattaaaccaaaatttttattggttttattattctcagctactgcattatcaagctgtattatttcattcatgcagtttgatgatctcacagcagaattggaagctgtatctttacaatgtgtctatttggctgaaaacaatcaagttactcaacaggagttatctatgaaaaaagtacaacaggaatgtgaaaaacttgaggaaaataaaaagatgttggaagaaggaatagtaaatcttatgacacatatggaaaaatatggtagaacttggtaaagtacaagaatataaattggagctagaagaaaaagcaatgccagcaatagaaaaaaaatagaagaaatccattaacacgttagtttttaaagtcaggtaagtttatctgtaatgtgctttcatttatttcactgcaaattacattttagatattatatgtattgtgtttactctgcctctcatagcaatttgtagagttctagaaacaggtggcatctgtgtttttcttttaaatatttaaatttccatcattattataacaaaattgatctttcagagtaatgattctcactatagactcacttgattgttaagacctgtaggcataagactattaggaaaagagaagattgtgatttagaaattaaatgatacttttgaattggtcttaagctacattgttcattgttcagtttttaaaattataaatggattctattactttttaaatgaccagattgcattaatactaacactactaaacatacactcatagaaaatggaataagcttattaatttgttttgaaagcataatctagtgagatgccttcaggagattagtagaaagtgaatgctaacttgacaatataattttggaaaataatgtcagtaaataatcttacctttaaaacgttagtcagggagaggttcggtgtctccttcctctctctctctctctctcttttgtatggcttttttttcctgaaaaaatctcatgtagttaacttgatctattagtttttttcactaagtatttttgaatcgttataattaataaagtgatcttgttataaaattacttgtcagaattaccctaagtagaaatattaatgagtttaatttactttttggtacatcacaacctaaacccaaagtgtcaagtactactgctgctctgggtatatcctggccctcaggcatggaactgtccttgattgtgatctttagtattatcactatagggcaccttaagaaagactattctgtgtaacattttcaaactacagaaaggcgttcttgtgaaatagggaataattattacaggaatgaaaggaagtgtgattcactaagtggtttcaaaataacaccttgttcagcctgaaggggtgtgtggaagacagaaagaaaaaaccccatctccagtgccttggtcacaatgttaggggctaattgtcttcagagatgctttagttctttttgatcaccaaccaagccatctacttctctactatgagttgttgctcagaattattcatcattgccaaatgcttaattgttcctagataatgggtgaaatgtacaagggtgaaacctgaaactggtttactaagcacaagtatttctagcggtttttttttttggttcattttagatttcttaaatgtatattatttaaggagtacaacaagccgttttgatataactatttatagtgaattggttcttatagtcaaacaacttaacatattcattttgtcacatagttaccctttaaatacaagtatttctaatagaatcttccaaatcttacaagtagagtcattttagaaagcagcaagtgttacctgttcagccccacattactgatagccatttctcttccctctctactttgtttgaattgcttattcagtagaaatcaccctagaaacacatgtacttcttttgaacgactttaaaattataattggttacaacagatatgctctcacacatcttcggtgagaaaacactttagtgggtaatttggtttactctctcagcaacttttaaaaaagtggaagtcattaagactcacttaaggaaaaatgaaatactaagcatttgtctttgctatcttcacagatcaaataagaaaacaagtgatcagcaccaagctccatatggagaaagagtggatgaaagcttttctcagtgctctttctatgaggccaggctcagagccaccttgtgttgaaaatcttaatagtataggactcaacagaaaatgtattcccaaaacacctgtaagaattcctacttcaagcccacagacttcaaattaccttttctattttgggttttatttcactaataatattcttgtttttaatttggtgaaatactgagttgttcagttgacctatgcatgttaagtaaagattatagttagccatattaacacagaaaggaaatgggaactttacttttttttaaattccccagagctctaattttcaagagacacccatttgctaactttattcagtaaatgtaaataaactgacacatttcaactttctttaaaggctgcacttaagttagattttagaaattgcatgttattgcctaataactgaaggtatattttgagatgctttggcttacgctctaattgattgtagtttggctgtggttcatgccacttttaaggtttctttgtaccatctcaactcttcccacccatactcacaaaggaatgattggcatccaaacacttaatcacacatgggtatttactatttaatagaatccaaaataagtgcattttatgaattaaataaacataaaatactaaaagattcatttccatttttattttaaaagccttgtgctcttcttacataagagtacatcctctgactataaaaatcctggaagtaaacctaggaaatattcttctggccatagtggttggcaatgaatatatggctaagtcctgaaaagcaattgcaaggataacaaaaattgacaagtgtgatcaaattaaactaaagagcttctacacagcaaaagaaactatcaagggattgaacagacagcctacagaatggaagaaaatattcacaaactatgcatacagcaaaggcctattatccagaatccataagggacctaaacaaatatacaaacaaaaaataactccattaaaaaatgagcaaaggacatgaacagacacttttcaaaagaacacatataagtagccaacaaacatattaacaattgcttatcactaatcatcagagaaatgcaaaacaaaacaacaagataccatctcacaccaatcagaatgaatattgttaaaaagtaaaaaaaaactggtgttgggaggattggagaaaagggaacaattacacactgttggtggcaataaaaaattagttcagctgctatggagagcagtttggaaattaagaactaagaatgatcattggatgcagcaaccccatttctatgctgggggtatacctaaaggaaaagaaatcatcgtaacaaaaagatgcatgcacatgtatgttccttgcagtactattcacaatagcaaagacatggagtcaaccaaggtgcatccaaggtagactgaaaatccaaagtagattggaaaatttcacatacaccatggattactatgcagccatagaaacaacaaaatcatgtccaacatggatacaactggaatccattatcctaagcaaactatcatagaaacagaaaaccaaatatctcatgttcttactcataatgtgggagataggcattgggttcacactgtcataaacatgggaatagtagacactgggaaataagaacggggagggacagagtaggccagggttgaaaaactacttattggatcctatgctcactacatgggtgacgggttcagttggaccccaaacctcagcattcctcaatatacctttggaagaaacctacacaggtaccaccttgatttagaatacaatctagaaaaaatttactataaaaaaggttactgtaagtggagaatagaaatttctttttaaggaaaagtttactgaagtaaaaaatggattgaacttttataaagggcagaattttgctaagagttttgaagcaatgtattcattgcaaaacatgactttaattgtttaacctttgtactaataaaacaccacctttttaaaattatttatatacaatagaccaatattaattttattgttatcagataaatctaaacagcattacacagatatatcctctattatctaaacttaaaataagtagaaattttattttatttatgtgattatttttctatttaaacaagtgttcaagttatgtgtagtcactaaatatactaaaggccacattttgtaagtgatatattattctcacgataatgtctcttgtttaacttaaacattattattatttttacttgagatggagttggactgtgtagaacaaataattagagaaacaaagaaaagtatgttgccaaaatttattaattaaatttagacttattttagaaataaactgtatatagcaaatggcattccttttcattgttgggttagtagatactatgttattcttttcttacatacatctaatgacagatgtgaaaacaaaaactttcacaatgaagagtatacttatgcaccattaattcatcatgttccatagcttaaaaaattcccaagaagtctatgcatcccttttttactggctctacactttattcacttttgtcattctcatggaactgtcagccagcacactcaaacaattctcagcaaacaaaggcatcatcaggttctcagggttccggtagagacttaagaccaacagacctcatgctcatttagaaatactcagctgagccataaccattcataagcagtcacttgacaggtgacattttaaattttctgtcatttactttgtcattggcttacttttgttctcaggaaaagttctaaatttttcaccatggaataaaaacacctacatcaatgtgattcttgtcaagttactcagccttgtctctagccacttaccacactctgccctttgctctagcaccaaactggatggagtggaactccacagggttcttcctcacctcaggctctttgccttcatctcttccctctatctggcaatcttttcctcgtccttcaggcatcaacctacctatcttctccaccagaaagcctatgatattgacacaaaactgggatagatgactcttctgtgtgttccagtagtaccctgctatatacctgtcatggcatctatgactctatgtggacattgcctgcctgtctgttttttcagattacagcatatgattgttgagaggtggaccatactatcttcatcttgtaattccagtgctggttctagtaccttagcacatggctgttgagtatgtgaatgaagaataaaaagctctcatatttaaccacaattgtaattaattccatgtgtaaatacgagcaaattctatttaatagtaattttgtattataattgtacatacatatttctcattcttattaaccctgataaagttctgaactctttatttatttatttatttattttgagatggagttttgctctttttgtctaggctagagtgcaatggtatgatctcagttcaccgcaacctcctcctcccaggttcaaatgattctcctgcctaagccctacgagtagctgggattacaggaatgtgccaccatgcctggctaattttgtatttttagtagagatggggtttctgcatgttggtcagactggtttcgaactcctaacctcaggtgatctgcccacctcagcctccccaagtgtggggattacaggtgtgagtgactgcacctggccaactctttagtttttaaacttacacatagttaactgaaatgttttaggtaaagaacataattctttatttttctttccagcttttgctgtgttggacattttctcccatctggtttcttctttagaatccactgatgagcaacaactaatgaagagaatatctaaaccataaaatcttaaggaaaaagtttatgatttaaaagacctaaaacatcttaaaactttattactgatctgtgtacatgacattttaattgtttctcataaaatatgtaacatcatgatcttcactaaagtagaatatgtttgtatcatatgtgtgatgaaaatgtatatggtattttaaatgattttttagcctctttaagttttaagttgatcttgtaaatgaaaaccagtattgttgagtttgacatactcaaattgcccagatttcagctgtttaaacagccaaacaatcaagtcatcattgatacttcagtagaggtcattgatggcttattggcattttatagcttttactactatatataataggagacttgaggagtaccagcctggtatgttcgtgctaatgttactatttcctttttttctttttttgagatgaagttttgctcttgtcacccaggctggagtgtaatggcgtgatctcggtcactgcaacctctgcctcctgagttcaagtgactctcctgccttagcctcccgagtagctgaggttacaagcacctgccaccacacccagctaattttttttttttatttttagtagagacggggtttcatcatattggccaggctggtgtcgaactgacttcatgtgatccacccacctcagcctcccagagtgttactatttcctttttgtagttcaacagtattttgtgtggagatattttgaggctctgtaaatatctggttgctcctcaaaacccactagatttagcatttcatggatgacttgtgtttgagcaattattaccgtaatgattgccaaatgattactttcttattctctcctttgttctacatggagaaataaaaccaatacataaccgagaagggaaagctcgtgattctggtcctcaaatgccccaagattaggccagtggtagacatttcaagctcccttcatctcttttttatttgtccccattagtctgtcagcacttttttactttctggcacaagatgctccaagcttatcttgtattttctctgccccagccctggaatgagtgattgttcttagaagcagaggtggagccaccgaggaagcacaggatgagcattccgcagcttgcacttactggtccccagtaggaagaaccactgctgcatccactgaggtaccaagaaagtagcaaagaaccttctgactgtctggggacagtcctcatgtggtccttggctcagcctgaaaggttctggattagtctccttgaagcccctgtgatttgtctctagacctgtgctctgcaggaagggccctgagagaccaagcagcacagggtgtctcatctgccaaatgtccctcccttcctcccactctgagactcaggaataggctagatgatgtgttcaggcagtgccaggccacctcactgtctcctttgagatgggcccagaggaccttggggggtgagtgagaagctgggcacatggagcctgaggctgactgtccctccctgtgtcttggaggaaaggccttgtcccaagaagacccacagggcctgatctgtgggcacacatgcagggagggatggtctgtgggctgactgggacattggaatgagactttgagcactgctgctcaggggcctggtcagtggcccatggtcagtgatgacctggtcatcaggacctggccagttggggcaggatcagggacctcgttagtggtggcctcctcagtgaaggcctcatcaatggggacctgaagacctagtcattggaagactggttagtggtgacctggtcagtggtggccttattagtggggcctggtcagttggaacataaacaaggaaaaagtagttggtgggatctgtatacttggggtctggtcagttggggccttaatgggctgggacctggtcagtgggagcctagtcaggggggcctagccagctagggactaattcatggagaattgtttagtgggattcgggtgagcagcaaccaggtaaattgtggtcttctcagtgggggcctggtcagaggaaaattggtcagtggagtctggtccatggggcctattaatgggggcctagttcgggagagatggccagtgggtacttggtcaatggggacctggtaaatggaagagtggacattaggaacctggctagtgggaacctggccagctggccgctgtgtgacctcaggcagggggtttgtctgaggaacctccttgcctccacctgtagggtaggtgagtcaggtcaccctggagggctactgggaagaggatctgagaagttgtattgaatccagcattgctgggcagacctagcactttacacacgacctagattccacctagggagggtgccagccctctgctgtacccagtgcccctcctctgcatccccatgaccaccctgggtggggaggacagagattggggagctcctgtggagacactaatgctggccccaggccctggtggtgacagtgatgaggacctgggtgcacctgtgagtggagcacctaggcctagccatagaagcaacacaaacacacacatgcacacaaaaacacacacacacatgcacaaacacgttgcacacacacatctcagttcaggggataagggatactgactctgtgccctgtttatccaagcaggctcccattgtgatgggttatgttgccccacgatgtcatcattgctgagcccccagtgcctctgtgttgtggagcagttagagacacatggcagtgtccttgagtggctctgagtgtgggaccattttctaggtgatcactcagcatagcttaccgatcagactcaagtgaatggaacctgccctcttcccttcctcctggctttggaacagttgctaccaggtgagtggtttttccctccagacagttactgagagtaatccctgagcactcactgggtgcctgttctgtgctgacagtcatctcattcatcctaacagcaattccattctgcatcttctctggacacccccaggaccatccaggacaaccctgcctgacaccaggcctagtgtggctccatgataacaaagacgcaggtccagagacaatccccctacatggtgcctgcatctgattccccttggtgggtagtgacgatcacaacatggaagaagccagggcagcttgcagccagctgctgtgcagccccagatggctcctggaccttgggaagtaattctcaaaggggaagctggtcactttgaggtccctggagggatgggtgaatgtggcatactggcaacgctgacagccagcagcatgccatacatctcacctaacatgtgggacagaggccccctccaagagcacgagtctcatacatgaagcatcctgtctcaggcctcatcctgagccctaggaggggaggggtaccgtgggccaccagcagcagccaggattaccacacacgggactcagtattctgtagccctggccagacttagaatttggcccaagacaggacaatatcactcggagcagcatgtcggtacttggggtctgtgcatgccaggcaagaccaacctggctcaaagagcaatcagccacctctataagggtgtcccaggagcaggtggaccagccaccaacctcacccactcaaggaagcagggatagccaggttcccacagcctgagtggccactacataacagctgatggagtagaggcctgaggaaagcagatggcactgggccctacctccagggtagaggaactgatatatctagattggcagcgtgtgaggttggtgactggtccacctgctcctggcacacctttgtggaggtggccgcttgctctttgagccagtttggccttgctggcatgcacaggcctcagtgcaacaactgtgctgcaaatggagccacatggaggaaatgagcagcaggctcaggagcaggctgtgtgctgcctttggggctccagtccatgtatcagttctcacacagcactgagggcttcttgggtgccaagaggcagaccacaggtcattttgaggaggactttatgtccagatgcagaaagggcccaatctggtggatgaaccacatgccagcttctgggtgcaggcacagtgccacatcttccatcacttcctgatatgtgccccaccagcactgaagagacagcctggaaacaggacaatataaaggctgagaagggtgagatggtgagtgccagcttccaaatgaccctgagtccacccccatggtagccttcaacctttaggaatcgaatgctacaccaagaagatggacaacagggcactcaactcaacttcacagccaatgagttgacatgcaagcagatgatggtggcaggctttaagaaggagcatcagaaggcaggcagtttttcttcagcctcagccaggccttggagctggaccaggccatccacttcaccagaggtgccagcaacaccatcagtgagctctctgccaatctgtcccaacaaggcctggaccccatgatgcacctgttattgttgtctcagggacaccagtccaacgtcctggacatcatccatgtacccaaggaagctcttgccaaagtcatggaaagcaggcaacatgtggcagaaaggaagcagaagtgcagaggctgatgacatcaggatcacggtaacaggatttatttggccactttggctgaaattcaccacttccatccaactaaattgagaaacttgaaatcacaaatgcagtatttcttgcaacaagagatactatttttccaaaaagtcacccaggaattgagagtgttgaatgactagatattcaactgcggactttttccagttcaaggataccttctacagcagaataataacactatcaaagagccagtgccagctattgtggtagtacaagtattgttttgtgttagactaaaacccagctgaatattgacttgtgcaggaagcagttaatatggtgatagaatagaaacagcaccaaactaaatcatactacaaatgcttacactacctttgtaacttttggaagaatgataataccatttacttcattgctttttgaagtatgaatattttagtgtatatgctgtagaccttatatttatgaaaagtctcaaagaagctggctggataaagcctgctgtagatggttttatactgaaagattgatgatatgattcaaatatgtgtccccaccaaatttcatgttgaattatgtttcctaatgttgaaggtggaagctggtatgaggtgattgaattatgaaaacaaatttctcatgaatggtttagcaccatcactttgctactctccttgtaatcatgagtgacttcttgtgagatctggtcattgaaaactctatgccacctccttactttccatgttttcctcttgccatgtgagaaaattcagtctttgtcttccacaatgattgaaagatttctgaggcctcccagaagcaaaagccactgtgcttcctgtacactgctgaatcaagggtcagttaaacctctgtttcaaaataaagcacacagaaaatggcaaatgaggattgaacgattgctatgaagatacctgaaagtgtggaagtagctttggaagtaagtaatgggcagaggttggaagatttgagatggctcaagtgaagacagatagatgggaaaatttctggaccatcttagagactgtttaaatggttgtgaccaaaatgctgacagaaacatggacagtgaaggccaggctgagaaaggtctcagattgaaataagaagacttcaagaaaatgtcttccttttggatacggaaatcttacacaatgcctgtaccactattgtaccttagaagcagtgaacttgctttctatttcagcacctcataggcaaaagagactgtagccttggctcagatggtactttgcactttctaactttgagttaatggtggaatgagttaagaatttgggagactgttggcaagggatgattgtttttgcaatatgagaaggacattaaattcgtgggagggacagaataatatggtttatctctacttccctaccagaactcatactccctaatgttagaggtggggcctaggtagaaaaagatttaatcataaaagggtgagggtggatccttcatgaatggtaaagcaacatgcccttaatgctgtcctcctgatagtgagttctcatgagatctggttgtttaaaagggggtggaacctcttttcttgctctgccttgctcccactcttgttgtaggagacatctcattgtccctaagctgtctggtgtgattgggaagctctctgactcttcccagaaacagaagacacaatgcttcctttacagcctgcagaacactcattaaattaaacctctattatttatgataatacagaaatttggtactgcagaggggagctgtgaaatgtcttcaaggccttttcccctttgacttggctatcagcactgggcttctttatgtgcaaatttctgaagacttcttgaatttttccccttaaatggggttttgtgttattgctacatagtcaagctgttacagagatacctgaaaatgtagaagcacgttcagaagtgggtaacaaagaatgggagagtttggagggcttagaggatgacagaaaaatgagggcctggtgagaatgatttgatcatgaacaggaggtgggtgagagtggaagaaaaaaggggtgggtaggatggggagaagtaggttggcagtagggtggtgggagtgtggagggtagtaggaagggggagtagcctgctgtagaggcagagcctcatggaaaacctctattagggcgttgcacctgtggttttgcagggtttagcctccatggctgctctcatggacggggttgctgttgagtgcctgtagcttttccagactgagggtgcaagctgttggtgggtatatgaatctggaatctagaggatgctgatcccctttgtggaagctcaaagcccactattttccttccgcactgccctagcagaggttttccaagaggctctgcttctgcaacaggcttctgcctagaaaccatggtgggtgagggtggaggatggatcctttactaatgggtaagcatcatcttcttgatgctgtcctcatgatatagagttctcatgagatctggttggattacagggtgtggcaccactttcctctctctgtcttgctccttttcctgccatgtgacacatctccttgccccttgaccttttggtatgattgggaggtttcctgattccctccagaagtagaagccactatgcatcctttacagcttgcagaaccatgagccaattaaacctcttttctttatgatcatacagaaaatatagtaccttgaagtggacctaggaaatgacttcaaggacttttctccattttcttggcaatcagcagtcagcttgttttcatgcaaatatctgaagcctggttgaattttccccctgaaaatggatgtttcttcttttacgacattcccaggctgtgacaaagctggaatgtagaagcaggctcagaagtgggtaatgaacagaggttgggagaatttggagagtttagaagacaggaagatgaggaaaagtttggaccactgtagagcattttactagtcatgttcagaaggctgacagaagcgtggatagtgaaggccagactttgaaagtctcagatgaatatgaaaagcttactgggaacaggagccaaggtcacttttgttttgccttagcaaagaaggtgtctgctaggtgaacctgccctggagattggtgaaagtttgaacttgctggtgatcatttggggtgtaactagcagaatgaccttctaagcagcaaagctcaagaggtatcctgtctgcattgaacagcctgtgctcttaggtgtgatcaaagaaatgacttcaagttggaaattatacttaaataagaagcagagcttcaaagttagaaaaatctgcagcctccttaagtggtcaaaaacgaaagctgattttcagagggaaaatccaagaaggctgtagaaatttacgtaaaatggagtccagtgctaatagccaaggcaatggggaaatggccttgaaggcatttcagagacctttgtagcagcccttgctgtcactggccctgaggactgtgaaagaataatggtttcctgaaacagccacatggcctcactgctgtgtgcagcctcaggacactgctgcctgcatccctgcagtgccagctccagctctagcaatggctgaaagatgcacatgtacagcttgggtcacagctttggggcctgcaagctataagctttggtggcttccacatagtgttcagccagcgggtgtgtagagcatgagacaagaggctttggagcctttgtatagattttggaagatgtatggaaatgcctgggtgtccaggcagaagactgccaaaggaggagagcctcatggaaaacctctactagggcagtgcagaaggaaaatatggggttggagcctccacactggaggccaccactctcaaaacctcagattcatacacccccaacagcttgtacccttagaggggaaaagctacaggcactcaacaccagcctagcccatgagagcagccatggtcactaaacagtgcaaagacacaggtgcaggtctgcccaaggccttgggagcccagccctcacacccctgtgctctggatttgggacagtgaagcaaaaaggatgattttggagctgtaggattgaaagacttgactgctgtgttctggaatttcatgaggcctgtaagtctcatctgcttttgttctttctggcaaaattcttccttttggctgggaatgcttacccattgcctgtgcaaccattgtaccttggaagtagataacttgctttatatttcagaggctcatgggcagaagggagtgtagcctgtgtcagatgagattttaagctataaacaattatgtaaatgctggaaagggttaagatttggaggactgtagggaaggcaacattgtattgtgcaatgtgaggaggacacgagatattgggggccagggcaaaataatatgattttgctctgtgtccctaccaaaactcatatggaattgtcatcgggaatgttaaaagtggggcctggtggaaggtgatgtaatcatggatgagagtgggggttggaagttgggaggtggttgggagaatggcagggattatggtggtgggggagggaaaggtcggggtggtgtgaatccttcacaaatggttaaacaccatctccttcatgctgtcctcatgatagtgattctcatgatgattttggagctgtaagattgaatgaatagtggctggctggattttgggcttgcattgggcctgtggtcccatttgtgttattttcctgggaaatttcttccctttggattgagaaagcttacccaatacctgtaccatcattgtaccttggaagaaaagaactcctttttaaattcagggactcatttgcagccttatcttatatgagacaatgaactttttacatttgaattaatgctgaaatcagttaagatttttggaaacttttgaaaagaaatgattgtattttgctctgtgagaaggacatgagattcagaagggtcgaggtcagaataatacggttagggtatttgtccctaccacaactcatgtggaattgaaatctcaaatgcttgaggtagggcctggtgggaggtgatataataatggaagggaggggggtgggggtgcaaggaaaaaggggtgggtagggtggggaaaagtaggttttcagtagggtggtgggagggtgaagggtagtaggaagcagagtagcctgctgtagagacagagcctcatagaaaaactctactagggcagtgtgccgtggattcacagggtttagcccccgtggctgctctcatgggctgggctggtgttgaatgcctgtagctttttcacattgagggtgcaagctgttggtgggtctatgaatctggggtctggaggatggtggccccctgtgtgggggctccacgcccatattttccttctgcagtgcccgagtagcagttttccaagaggctcggcctctgcagcaggttctgcctgaaaacagtggtgggtgggtgtgggagaagatccctcacccatggttaaccaccgtcttcttgatgtgggcctcatgatagttctcatgagatctggttgtataaaagcatgtggcacctctttcctctttctgtctttctcctactcctgccatttgaaacatctcattgctcctcagccttctggtatgattgggaggcttcctgggtcctcccagaaacagaagccactctgcttcctttacatcctacagaaaccagagccaatttaacctcttttctttatgatcacacagaaaattagtactgcaaagtggagctatgaaatgccttcaaggccttttcttcattatcttgcctgttagcattggcctaccttttttatgcaaagatctgaagctttcttgaattttctccctgaaaatggggttttcttcttttaccacattgccaggtgtgactaaattagctgaaaatgtagaagcaggttcagaagtgggtaacagccaaaggtcagagagtttggagggctttgaagaagatagggacatgacagaaagttggacctattgtagaaatgttttaaataattatgattaaaaggttgacagatgtatagtgaaggccaggcttagaaggtctcagttgaaaatgaggaagttatactgggaataaaagcccaggtcacttttgtcttaccatagcaaagaacttagccgactggtgaccctgccctcaagatatgtgaatctttgatcctgagggtaaagatttagggtgtatctgggtggaatgaacttctatgcagcaaagctcaagaggtgtcctgtctgtgtcaaacagcctgtgctcttacgtgtgactgaggaaatgacctcaagttggaactcatatttaagtgagaagctgagcttaaaagtttggaaaatttgctgctggccaagtggtcaaaaagaaaagctgattttcaggagggaaaatttaagaagtcttcagaaatttgcataaaaaggagcccagcgctaatagccaagacaatgagaaaaaggccttgaaggcatttcagagacctttgcagcagcccttagtgtcacaggccctggggcctaagagagaagaatggtttcctgggccagacccatggccctgctgctgtgtgcagcctcaggacactgcaccttgcatccctacagctccagctccagcttcagccctggctcaaagatgcacaggtacaacttgagtcactgcttcagagggtgcaagctataagccttggtggcttctgcatagtattaacccattgggcacacagagcccacgactagagtcttgggatcctcctcaaagacttcagaagatgtatgggaatgcctgtgtgtccaggcagaagcctgcccaaaaggaggaacctcatgggaaacctctactatggaagtgcaggaggaaaatatgggttggatcccccacactggtttgtcattgggaatgttaaaggtggggactggtggaaaatgatttaatcatggatgagagtggggactggaaggtcgggggtgaggagaatgggacggatgatggtgggagtgggaggtgaaatttggaagtgtgggggggatccttcaaaaatggttaaacaccatctccttaatggtgtcctcatgatagtgatttctcataattattttggagccgttagatcgaatgattactgtcttgccgggttctggacttgcattgcgcctgtggttgctttcgtgttatttttgtgggaaatttcttccttttgattgagaaagcttacccaaagactgtaccatcattgcaccttgaaagaaaataactccttttgaattcagggactcatcaacagaagggactgtagccttgtctcagatgagactttgagcttttaacatttgagttcacgctggaatgaattaagacctaggaaacttttgaaaaggcatgactgcattttgctctgtgagaacaacatgggatttccaggggtcaaggtcagcataacacggtttgtctgtgtgtccctaccaaaccttatgtggaattgtaatctcaaaccccagaggtggggtctggtggacggtgatttgatcatggatgggagtggcgtgggggtggaatgaaaaagtggtaggtggggtgaggaagagtaggtttttcagtagggtggtgggagggtgggggtagtaggaagtgggagtagcctgctgcagaggcagagcctcatggaaaacctctactggggcaatgcacctgaggctttgcagaatttagctcctgcagctgccctcaagggctgaactggtgttgagtgcctgtagcttcctcacactgagggtgcaagccattggtgggtctgtgaatctggtgtctggaggattgtgtcctgtgcgggggctccaaacccatattttccttctgtattgcccaaatagaggttctccaagaggctctgtctcttccataggcttctgcctggaaacagtgttggttgagggtggggggtatatctttcacctatggttaagcaccaccttctagatgctaacttcatgatagtgagttctcatgatatctggttgtataacagcatgtgacacatttttcctctctctgtcttgctcctacttctaccacatgaaacttctcattgcctcttggccttctggtatgattggcaagcttcctgagtcctctcagaagcagaaaccactctgctgtttttacagcctgtagaaccctgagcaaattaaacctcttttcttggcctggcatggtggttcatgcctgtaatcacagcgcttttggaggctgaggtgggcagatcatgaggtcaagagatcaagaccatcctggcaaacagggtgaaaccttgtctctactaaaaaaaaaaaaaaaaaaaaaaaaccaaaaaacaaaaacctgggcctggtggtgcacacctgtattcccagatactcagcagactgaggcagcagaatcacttgaacctgggaggtggaggttgcagtgagccaagatcggaccactgcactccagcctggtgacagagggagattccatctcaaaaaataaataaataaaaataaaatactcttttctttatgatcataccaaaaattagtattgggaagtggagctataaaatgccttcatgaccttttccccattgtcttggctattagcactgggctgcttttatatgcaaatatatgaacccttgaattttccccctgaaagtgaacttttcttcttttaccacattgccaggttgtgacaaagatcactgaaaatgtagaagctggttcagaatattggtaataaagctcaaaatcctgaggaaattgaacactcaaataaaggattcttagcaaagcaattttacttctgcacagaggggtgcttctccttggccagtcaccatgagagcacatctgaacaaaggggcatgagagcctttattcctgatgcaattcctgcccctgtacccttttcccattggccagggtcaggtcacacaatctgaactaatcctggttggctaaacatttgaactttctttagataaagtgggcacataagggagagaggggaaaaggggaaggggtgtctgcaatgacctagagaggtagtcttttttccaaataaggaaaggaatgtgaacttgtactgataagcctggtactgtggtgtgtctgggcatgtaacaaaggcagaaaggaaaaaagacaaaaaggaaaagggggtgagcatgggtaatatgaatgaataaaggattgatcaggctatttgaagagaaacctcatcatatcacacaagaagtgagtaatggccagaggtcagagagtttggagggcttggaagaagacaggaacatgagggaaagtttgactcattgtagagacttgttaaataattttaattaaaaggctgacagaaggacatacagtgaagccaggcttagaaggtctcagatgaaaatgaggaacttactgggaacagagccaaggtcacttttgttttgccgcagcaaagaatgtggctccacagtgaccctgcccttgagatctgtcactctttgaacttgagagtgatgatatagggtgtatctggtgaaatgaacttctaggcagcaaagttcaagaggtgtcctgtctgtgtcaaacagcctgtactcttatacgtgactgaagaaatgacctcaagttgggactcatatttaaatgagaagctgaacttaaaactttggaaaatttgtagcctggccaagtagtcaaaaacaaaagctgattttcaggagggaaaattcaagaaggcttcagaaatttgcataaaaaggagcccagtgctaacagccagggcaatgaggaaaaggccttgaaagcaattcagagctctttgcagccacccttactgtcacaggccctggggtctatgagagaagaatggtttcccgggccagacctatggctccactgctgtgtgcagcctcagttccagctccagccatgggtcaaagaggcgcaggtacaacttgtgttactgcttcagaggatgtattctataagccttattgtcttttacatagtgttaagccagcgggcacacaatgcatgagtctacaggcttgggagcctctgtctagatttcagaaaatgtacagaaaagcctggatatccaggcagaagactttccaagaggcagagcctcatgggaaacctctgctagagcagtgcagatggaaaatatggggttggagccacccctagaaccttgggtctggaagcaggccaccatcttccagaccccagattcatagacccaccaacagcttgcaccctaagtgtgggaaagctacaggcactcaacaccagccccagtctgagagcagccacagaagctaaaccctacaaagccacaggtacaaagctacccaaggccctaggagtcccactctcagtcctgtgtgccctgggtgtgggatataggttcaaagaagatgattttggagctgtagtgtagcaggagaagcctcagacaaaacccctcagataccaagttaaagaaggaagggatttatttggccgggagcttcagcaagattcatgtctccaacaaccgagctccctgagtgagcaattcctgtcccttttaagggctcacaactctaagggggtccacatgagaaggtcgtgattgattgagcaagcagagggtacgtgactgggggctgcttacaccagtgattagaatggaacagaacaagactgggatcttcacagaacttttttaacgcaagtaactgattaggtcggggtcgatctttaactaccagacccaggatgtggcgccaggctgtctgcttgtggatttcattcctgccttttagtttttacttcttttttctttggaggcagaaattgggcataagaaaatactaggggtggtctcctcccttagtaggattgaatgactggcctgctgggttttggacttggaaggggcctgtaaatctcagctgtattttgttctactttctccaaaattcttccttttgaatttgaaacgctttcccaatccctgcagtcattgtgtcttggcagtagttaactcgctttatatttcagagactcatgggcagaaagaactgtaacactgtctcagatgagactttgggctttggacatttgagtaaatgctggaatgagttaagatttgggggactgcatagaaggcatcattatatttgacaacataactagaacacgagatttgggggccagtggcagaataatatggttttgctgtgggtcccttccaaatctcgtgtggaattgtcatcctggatgttggaggtgggacctagtggaaggtgatttaatgatgttctggagtgtggggtggaaagtggggaaggagtgaggagcattgtgaggagtatggtgggtggtggggagtgaaatgtggggatgggatccagatctttcatgggtgctaaacaccatttccttaatgctgtcctcacatgagtgagttcttgtgatgattttggagctgtaagattgaatgaatactgtcctgctgagttttggacttgcattggttctgtggtctcatttgtgttatttttctggcaaatgttttctttttggattgggaatgcttatgcaatgcctatatcatcattgtatcttgaaggaagagaactttgtttttaattcagaggttccttggcagaagggattgtagccttgtctgagatgagagtttgtactctatacatttgagttaatgctgaaatgagttaagaatttggaaaacatttgaaaatgcatgattttgttttccattgtgaggaggacatgagattttgggggccaaggacagaataatgtggtttggctgtgtgatcctaccaaaactcatgtggaattgtaatctcaaatgttggcagtggggcctggttgggggtgatttaatcatggacaggaggatggtggacctggaaggaaacaagagtggataaagcagagaggagtaggttggtagtagggtggtgagaaggtaggggttagtagaaagagggactagcctgctgcagaggcagaggctcatggaaaacctctactagggcaatgcatctgtggcttttcagagtttaacccccatggctgctctcatgggctgggctgatgttgagtgcctgtaagtttttcacactgagggtgcaagctggtggtgggtctatgaatctggggtctagaggatggtggtctcccacgtgggggctccaagtccatatttttttctgcattgccttagtagaggtttttcaagaggctctgtgtctgcagccagcctccgcctggaaagagcagggggtgggatgggggttgcattcttcaccaatggttgagcaccatcttcttgatgctgacctcgtgagagtgagttctcatgagatttgcttatataataggatgtgacaccactttcatctctctgtcctgctcctccttttgccatatgaaatatctctttgcccttggccttctgttatgattgggaggcttcctgagccctcccagaagcagaagtcactgtgctttctttacagcctgcagaaccccgagccagttaaacctctttttaaaataacatggcagaaaactagtactgtagagtgaagctatgaaattccctcacggccttttcctccttcttttgcatcagcacttgcctcctttcttattcaaatatctgaaaccttgttgaattttccccctgaaaatggatgtttcttcttttaccacattgccaggctgcagcaaagataccttgcaggttcagaagtgggtaaaggacagacaatggagagtttgaagggcttaagagaatacagcgaaatgggggaaactttgaaccactgtagacttgttaaatagttgtgatcaaaaggctgaccgaagaatagacagtaaagaccaggattagaaggtcttagatgaaaatgagagagttactgggaacagaggccaaggttagtttgttttgtcatagcaaagaatgttgctgcatggtgcccctgtccaggagacgtgtgaaattttgaacttgagggtgatgacttaggtagtatgtggtgaaatgaacttctaaggagcaaagctcaagaggtgtcctgcctgcattgaactacctatgctcttatgtgtgaccaaacaaatgacctcaagttgaaatttgtgtttaaatgaaaagctgagcttaaaagtttggaaaatttgcagcctggccaagtggcaaaaaaaaaaaaaaaaaaaaaaaaaaaaaaaaagctgattttcaggggggaaattaaagaaggcttcagaaatttgcataaaaaggagcccagtgctaacagccaagacaatgggggaaaaggcttgaaggcatttcagagacctttgcagcagcccttggtatcactgaccctgggacctatgagagaagaatggtttcctctaccagacccctggccttgcttctgtgtgtagcctgaggacaccactgcctgcatcctgcagctccagctccagctgcaactccagctccagtcatggttcaaagatgtacaggtacagcttgggttactgcttcacagggtataatttgagggggaccaggggcagaatcatataatttggctgcattttcctactaaaactgacatcatatcataatatttcatgttggtggttgggtctggatgccaaggtgaggagaggtgaaaagtggggatggtgttcagagtttgcaggactagagtggtgggctcggagcttatttggagagaggggtattgtacattttcagggcatgggggtggggcgcagattctttaccaatggttaagcaccatctccttgatgctgtcctcatgatattgagttctcatgagatttgcggggttttttgtttgtttttttttatagtgtgtggcaccactttcctctctctcttgctcttactttggccatatgggacatctctttgctccttggccttctgggataattgggaagcttcctgagtcctgccagatgtagaacccactttgccttctttacagtctgcagaaccatgaggcaattaaacctcttttctttatgatcatagagaaaattggtactgtggagtggagctatgaaatgccttcaaggccctttttccattgtcttggctattagcactcaggttttgttttatgcatatatctaagccttcttgaattttacttctgaaaatggacttttcttcttttacctcattacctggctttgacaaatatacctgaaaatgtagaagacagcttagaagtgggtaacagacagaggcagagagtttggaggtcttagaagaacagaataagataaaagaaagtttggaccattgtagagacttgttaaatagttgtgattaaaaggtcaacagaagaatggacaatgaaggccagagtgaggaggtctgaggtggaaatcaggaacttactgggaacagaagcaaaagttacttttgtttggcattaacaaagaaagtgactgcatggtggccccgccctggagatctgtgaaactctgaacttgagggtgatgatttagggtatattcggtggaatgaacttctaactagcacagctgtagatatgtcccacctgtgtcaaacagcctgttctcttatgtgtggaccaaaaaatgacttcaagtcagaacttacctttaaatgagaagtggagcttaaaagtttggtaaatttgcaggcttttttctcaagttatgcatttttagaatgacatgaggtttggagggacggggcagggtaatatggtttggcttcatgtccctgccaaaactgatgtcaaattttagtttttaatgatgaagtttggacagtaggtgttgatggactcatgtgggtgggttattaatgaatggtatagcaccatccccttgatgctgttttcatgatagtgagtgagtttttatgagatctggttgtttataagtgggttgtacctctttttctgttttgcttctgtgcttattatatgagatgtctcagtcttttttttgccctcctttctgacttgaagtttcatgaggcctctcagaagtggaaactactatgctttttatacaagctgcataactatgaggcagttaaaacttattttcacatgataacactgaaaataggtgctgaggagtgaaacacttgactaaagatacctgacaatatgggaagaggtttgggtctgggtagtgggcagaggttagagtttggcatgctcagtaggagatggggatttaaggggaattttggaacatctttgagattgtttaaatgattatgatcaaaatgttgacagaaatgctgacagtgaaggccaggttaggtggtctcatagggaaatgaggaatttagtgggaattggaacaaaggtcacttttgtcttgccttagccaaaaatgtggctgctttgtgcccattttatagggatgtttaaaactttgaacttaagtgtgataatttagaatatctagcataataaatttataagcagtgaagcattcaagaggttgtgtgtctgcttctaattgcctgtcttcatatgagtgagcatagaaatgacctaaagtgtgaatttatatttaaagagaaagcagagattaaaagtttggaatatatgtagtctggacatgtggtagaacagaaagcccatttttaggggagtaattttggatgacttcagaaattggcatatgtaaaaaggagccaagtggtaatagccaagacaatgggggaaaggcttccaaggcatttgagagagctttgcagcatctgctttcatcacaggttctgaggcctaggaggaaagaatggtttcatgggccaggcccagggccttacatccccgcacagcctcaagagaccgcttcttgcatttcatctgctttctctccagctcaagacatatgtcaaaggggcccaggtatgactcattttacttcatcagatgtttaaagccagaagccttggtgacgtctatggtttttttttttttttttttttgagacggagtcttgctctgttgcccaggctggagtgtggtggcatgatcttggctcactgcaagctctgcctcctgagtttatgccattctcctgcctcagcctcctgagtagctgggactacaggtgcccatgaccacacccagctaaatttttgtattttttagtagagatggggtttcaccatgttagctgggatggtctcgatctcctgacctcgtgatccactcaccttggcctcccaaagtgcagggattacaggcatgggccactgcacctggccctctatgtggttttaagtctgcaggtgcacagagtctgcaggtgcacagaggcttggagcctccactcggaacccccacctagattttagaggatgtatgcaaaagactgagtgtccaggtaagagctgactctagggatgtggctgttatcaagaatctcttctagggcagtgcagagggaacatgttgggttgagcccccaacacagagtttccaccggggcactgcctaatgatgctgtgagaaaggagctaccatcctccacatcccagaatggtagttgcaccagcaacctgcaccctgagtgtggaaaagccactggcacttaatgcctgctcagcttgttactgcagacatgggggtggaaccctgcaaagcaacaggagtagagtggcccaagcccttgggagtccaccccttacaccagtgtgtcctcaaagtgggacatggagtcaagattattttggaacttcaacattttatgacagccctgctaggatttagacttgcatggggcctgtagtcctgtggggtttttttaagcaaattttttccttttggattaggaatgttttgccactgcctgtacccttattatatcatggaagtaactaactcatttttttattttacagtctcataagagaatggaagtctagccttgtctcagatgagactttgaactttggacctctgagttaatgttggaatgagttaagaatttgggagagtattgggaaggcatgattgtatttttcaacgtgagaaggacatgagattgacaggtcaggggcaggataatatgatttggctctgtgcctctcccaaaacttgtgtcaaactcatgtaatccctaatgttggaggtggggcctggtggcaggtgactgaatcataggggtggatgctttattaatggtctaccatctttgtttctgtcttgatcctgctcccaccatatgaaacatcttagttctcctttgccttctgccatgtttggaaggttcctgaggtttccccagaagtagaagctgctgtaattcctctacagcatgagccaattaaacctcttttctttatatgttacctagtctcaggtatttctttatagcaatgtgagaacatactatacaattgaaattacctaaattcagtctgttctctatttaggtcctagagcagcattgctactctgtgcttttaaatttatctgcacaccttttttttcttagtgaaaggctgaaaggtgagtacacataaaacagagtgatgatcatacattggcagtggaggttgtgggatcgaggatcagctgccaacaaattggacagctagtattatgatctgataaaatgctgggacatgcagaggtgtgagattcagtgcacatcttttacatgaagtctgttagaaaagaaataatgcactgtgttcccttagaggcagctgtagcatcatctcgtcatgcaagtgtcctgaaacttagtttgataatttcagcaaatgtgtcttctggcatgagaaggaggattctcttctgtcagagaattaaagtgtagaagcagtgatgacacgcacttggtttcagttcttaggagagtttcgtttttgatgttttagcttgaagattttccttcagtagtgtttttaaaatgaatctatactggtaactgataaagactctactatgcaattcactcattgaattaaaaaatttccaaggttgtctgtaaatctcagggttctatgtcatgaaaactggtatcggttgatgtaaggaggaaccagaaataatttatttccagtactgaagaaaaaataattgatttatagtttgatttttaaaaagtattgataagtccccagaacatttaatcttgaaaatattttaaattttaaaaggattataatgcaaataaaaatagctgataaatatgaagattcaaaaggagcttaatttaaaaagcacaaagagattgtcttgcattgctgaaatctcaatatttttatagttcctgggctaaataatttgatgttgagtttacagatttaaaaactgtggctgaaaggttaaagtctctactatttatatgaagtccaacttatgctgccccaaatccctgggtactgaaattgtaacaagtcaaattgaaacactgatgaataacaatgatgaaataaaatgatccgtttgcagatagtcataaaaagaagagattactaaaatcatcatgcagcagcacattgactctcagaagtaatttcttatgggttgaattttaagatcagattctcataattttgatatttgctcaaaacttcgtcccttaggttacttagagccagatttaacatcaggtggtgttgtctgtactacacacatgtagactgtaaccagaaatattgttctctaaaaacaagatcgaacaactaccaaaaactaattcagctcctaggactgaagaaaactgggcaagtgaggttcaggaggccaggtgcctacctctgccatccttggcagttgcattttatggtaagaaaacatcaagatggcaccactcactgaaaggaggctccaagttgggaaccagaggtaccagcttagattccttaatccctaagaaggcctccctctcaaagacaaagaccccttccttggcctcaagtcctcattcttgttggttaaacacaattaattcttcatcattatcacctgcctgttttttgacttgcccagagctctgaaggaaaccctggacactctgcggcaagcgcgaagagagggctgtgcagcccaggcccctgatcagcttctcccagcctttccctcccaaaggctatagcagggctgagtgccaacatggacctgcagaggcctgggaggggagcaaatggctggggttcttgtggcatttgggatgttcatgacagttagtgcaaagcatccatggcaggatctgttgtcacctctctccaccatccctggattgccaggctccagtggcctttctttcctctcttcttctctgccctccctccctccatttcctccctccctctctcttcctctctctccttctgtcttttcttccctcctgttttccctttttcttccttcacatctatgcctcctcccagtatctggcagccccatgtcctcagcctgtgctgggtgagtctgatgaactcagacaggatgtataggaggggctttcatcagttcatcctgggcagctgttctagaagtgactacgatggggcaaatgcatgggtacgtgtgtgtgagtatgcacaagtgcgtgtgtgtgcctgtgcatgcctgttgaccacatgtcttctctaagtttgtgtccataactccagaggaccccaggtgtgctctcgatgtcatgttcagggatcaagcacagctcctgctggtgggaattgcactgtgtgacactttcctcagggacctgggggtgtcagatcccagtagtctcccagtaggctttcagataggtcagaaagatgttctattgttgttttattttctttttttcatccatggttttactaccttcttcttcttagtgatttttcatgaagggacatctgggttggggaaaggtagctaataagaaatgatgtcaccataaaatagcaaagagtctcctggctctgtggggacagtcttcatatggtccctggcccagcctcgagggccctggtccagtcaccttatggcctctgtgctgtgtccctagatctgggctctgtgggaaagaccctgggagacccagcagaatggagtaccttgtgtgccaaatgtcccccctttactctggctctatgactctttctccctgtgtcctggaggagaggacctgtctggagaagaccctcagggcctggccctgtcgattaagataggagggaagggtctgtggcctgaggcagggcattggaagggaattttgagcactgctgctcaggtgcctggtcactgggacccagtgtttcccttgtcagcaggggcctggtcagtgggactgtggtcaggggactattgatcagtgtggcctattctgtgaggacatggttagggggaacctggtcagtgggaacatttttagggggatcagtcagtggggaccaggtcagtgaggacctggtgagcggaggcctggtcagtgggacctgggcatcggggcctgttcagtggggacctgctcagtggagatgttttcactgtggtccccctcagtgggacctagacagtgggggcctgatcagcgagacctggtcagtggcaacctgatctgtgggaacgtggtcactggggacctggttaatagaaacctggtcagtgatggcctaatgagtgaggtcttgatgagtggggaaccttgtcagtgaaggcctactcagtggggttagtcacttttgacctgacagtgagcacctggccactttggccttgccagtgggggcttggtaagaggggcctgatcagtgtgggcctgcttagtggacctagtcagttgggacattgtcagtgaggtctatttagtggggtcctggtcaccatgggctgggtccctgatgaccaggtcatggggctctattcagtggaggcctggtcacatgggacctagtcagcagggcctggtgggcatgtcctcatcagtgaagcccttgtcagtgggtccatggttagggcatcctggtcaatggatcataatcagcaagggcctggtcagaagagaattggtcagaggggacttggtcagtggtggcttttgtagcactggtctaatcagtggtgacctggtcagcggggatctgagcagtgagtgcctgttcagtggggcctactcactagggttctagtcatggacatctggccacctcaggcctggccagtaggggcctcatctgtgggaccaggcaatggggtcatgattggtggaacctggtgactgaggccttgtcagtaaggacctggtcagtggagtcctggtcagttaggccttgtcagtaaggtcctgggcagtgggtcctggtcagtgggttctggtcattgtgggcctggcagtgggggcctggtaagtgtggcctggtgagtggggtataatcagtgagggtgtggctagggaggaccagctgtgcagggtctggtcagcagggacctggtcagtgggggctgctgagcattgctgggagatgtcaggtgtaacatgtgttattgatggtcctgtagacacctgggatggcccagtggtgcccaacagcccagttaaaagtggacaaggcaggtgtttggatggacttgggaggtcttgctcagagattccgacagaataaaggtaaagaagggccagagtggctggagagatggtcacagtctgtgggctacacaggatggaggaagtcagggtgttcccaggcaaggtgggtagctgggatgcagggagaggcaggtggatgctgagaggtcagatcctgcgagggctctgggggcatcaggtaggatgggctcttgtagggtccatccccacagggtctgtgggtctctccccgtgtgcagagatgagagagtgtagaaataaagatacaagacaaagagataaaagaaaaggcagctgagcccgggggaccactgccaccaagtcactgagaccggtagtggccccaaatgccaggctgcactgatatttattggatacaatacaaaggggcaggataaggagagtgagccatctccaatcataggtaaggccacgtgggtcatgtgtccactggacagggggcccttcccttcctggcagctgaggcagagagagagaggagacaaagagaaagacagcttatgccattatttctgcatatcagagacttttagtactttcactaatttactactgctacctagcaggcagagccaggtgtacaggatggaacatgaaggtggactaggagcgtgaccactgaagcacagcatcacagggagatggttaggcctctggataactgctggtgagcctgactaatgtcaggccctccacaagaggtggaggagtagtcttctctaaactcccccggggaaagggagactccctttcccggtctgctaagtagtgggtgttttcccttgacacttacgctaccgctagaccacggtccacctggcaatgggcatcttcccagaagctggcattaccgctagaccaaggagtgctctggtggccctgtctgggcataacagaaggctcgcactcttgtcttctggtcactcctcactatgtcccctcagctcctatctctgtatggcctggtttttcctaggttatgattatagagagagaattattttaatattggaataaataattgctacaaactaatgattaatgatattaatatataatcatatctaagatctatatctagtataactattcttgttttatattttattatactggaacagctcgtgtcctcggtctcttgcctcggcacctgggtggcttgccgcccacaggctctgtgcaccatcagtgcactgggcaggtctcagcccaggctccctggaccctggccaggtgatgtggtcactccatgggggactgctgtcatgccctggccacccaccctgggcagcacagtcttatctcatgattggcctttctctgatcctgcagagggcacagctcgcagcccaggaggggcagtcccagggtgcagcttgagttctccacgggcctgaagcatcccctgccagccctgtactttctcttctcccaggtctcgcttttccagtgtcacccagcaggaaggccccatcctcccttccttgtgtgtctcctaggctgagacctgtggtggatggggacagggagagtacttcctcaggtccacttggggaggagacttgctcccagcctggtgaaggtagtcagctttaccttggttgccttagaatgagatggatctgcccccttttagtgccctcaaggtgaaggtgagagacggtccctgctgtgcaggaggttggtttagggatggaggacttggcaggtcctcccagactgtcaggcttgggcagcactatccaatttcaggactcagaaagtccagccctgagacgggactgtgctgcccagggtgggtggccagggcctgacagcagtaccccagggagtgaccacatcacccggctggggtccagggagcctgggctgagacctgcccagtgtgctgagggtgcacctggagcccaccccacctgacactcccacatcctcacaggttcttctctcctagcatgcacttgcctttccctgctcctcagcagcccactctgcctcttccctgacttcctccatggtgtccagcaggatgggctggacaggggggcagcctgtgtgcacattttgtggaagtgggactaacacacactccctgggaggcaccatggttcctgccaaatccaaccccagaactctgtccctgaggtggttttactaaaccctaaactcagaactgtggctgtggctcaggggtcagcacctgctagtgccaagacactactgggagtgtgggaccttagcaaaccccatggtgtctggcctgaggacagggtgtcttggggctgagacaaacactggggctgagaccgtctgacccaactggccaccaatggccattgggtcagatgatctcagccccagtgtttgtccttccctggctccttctggttcagtcccatcaaggccctggagcccaaatcccatcatcaaacatcccctccaggaatcctggccactcaattcactttatcgtgtttcatcgtagagcaaaaatgacagaacagatgcatagaaaaatggcttcagttgcttaatgactagaagaaatctgggagaagcaagaaggtaatgtggagagggagagacctccatgatcactctctgcagagccaggggcacaggcacccagtgcagaggcctgatgccacctgcctctcagagggtgtgtggcacactgtcattacccggaagacatcaggtctggtcaccagcttttctgcctgtcctgtaagcatcaagttttggaagagaatctcatgccagggcctggaacacacctggctcaggggttaggggttgccccttggtaatctaaatgaaaaaaataggtccagatcagagttcctaatgcggagcactcatccactctttgaattgtaaaaggggaggcctggtcctaggtatacctaagatctttgaggaactgaagatcccaagattctggaaaattccagagtcctcaggccctaatcctccctgtcctcctgtggcctgtcccatcagcacactcttctatctgtagatgttttggctgctctgtaagggagtccccctgcaggtttggggctgggcatggtcacccctgctgcatgtcgagaaggtgaaagccaagaacacagggtacagtgtttccacgctcatccagagcaggacaaacaggccaggttgtgtcaggagcccaagtatccagttggtgcaaatgtcaaacctgctgtggaaggaggggtccattgcccatcctaggtacagatggtaatgtagcgcaggtaagctgggcttggtagccctccctagctttggaaataagccaaacaaggagctttctggagaatgaaatctcttttccttccagaagcactcctgaatttttggtgattgccatttgtggcagtgagtttttgtctgttctggggctgggctggtttctctgattggccctgccctacagagcataaaggaaaagtgcaagaggtccccagcaaaaatgtgcagatagccctggacataagccacattctgagaaacatgtcatgttctgagaaggctaaggcatcaagtaaatcatatgggactggaggatcccagggtaggtggggcagttcagagcagtgcgggcttccctgggaattgggagaggcaggggttccagaggagggaatcacagggccaccaagggctctcttggccctgggagaagtcaacataatggattgaacacctgctgggcttcaagccctgggccaggctggggcatgtggagctaggaggcagctcaaattgggaggcagagagagaagtgtgctgagacggcgccgtttctgggtgtaatatggtcctgagattctgtatgggaagtgcttccagggtttcatatgttatggggttgcttcctctccccagcctcaccctgcaggaatcccagtgactatatcgccaccatcttggagctcagtgccctcataatgtaacggcaacagcagatcttcctgcacagggactttctgtactacgtcactgctgaggggtggtgcttctgcagggcctgtgttgtggtgcacaacttcagacaccatcatcctggagcagcactgcaccctcactagccagggagttaataacttcctgaaggtcacagccacattcaagactttggacttcattgatgtgcttgtgctggacaaggtgggcttctctgggatcttaattcaggaggtaggatagagcttgacataaaattcagataaaagaacttgaccttcatctggagggctctggggagccatggaagttgctggaagaaaggtgggaaaactcagataagcttcagtgatgcctgtagaaggctgtctggaaggaataaacaagaggcaggaaaccagggagggagcttgtggggcagatcttgagatagcaagggagggttcctgcttggatgatagttcttcaggggctgtctctgtcttcaggtgtcttcagagctagtgtgttcattggtcttgtctccaggtgaaattgggaagttgtcagataagcacataaaagtggaagctgacatcttcatgagtgctggtgggggtcctggtgtgggactactgtgggaacagggatctctcaatcccagggatgtggtggatgggccctggattactccatcctctatgcttcctttcccctcctcccattctcccgacggcctcagtgcaaaggcactgttcatcctctggtgctgaagcagcctagagtctcaagcctgctggcggcctcgcaggatatgacagcacagccagtggcctcttctgggtcctgtacatcttcacaagacaagtagacatcaggagtgctgccagcacttggtgcaggagttctgagggaccacagtcctgaagacattgaatggtgggtgcagggccttatgtcctgtttcccaccccttctcattggttctgctccaggtggggaagggggaaaaagtttttgccaattctaccattattgccttgcagaaaaaggagcagaggccagaagcagggactggtacccacccgggctaataagggagaatttgtaggctttgtggaaagatctgggagtccatatctgttgtcccactaacttgctacgagacattagtaaaatcagttttttttatgaactacatttctgccatctgtaaattggggcgagatttttctaccccatggggttgcttggataattggtgatggtgtgtgtagagcaggtgccacctggcaggcattcggtgtccagccactgctcttcccccttgctcttctgcctaagtttgcattttcttctcaagaccttcactctccctaatttttctcttacctctgattcccaccttatagtctattccatggattcaccaggatctaagtaggtgacagtaatgtatgcatgtatgcgtatatagggatgtacaccctcacacaccacacctcaacatagtaggtgctcagtgaacatcacactgcagaagcagtgctggtagatctagagtttcacctcaacttgcagttgaaaaatctgagtatctgaaagggcaaatggaagggtgaagtcatggtggcccagtgcccttcctatttgacctggaacaggtgtctcaggatgtttggacaccacattttcaattttgggctggctgcttggtcgggaggaggtggacaagaattagaggctcttcccacaccctccaagccttccccagggtacaagaacagaccagggcaaagaagtcctggagcaggggagagacctttccatagcagaagccatttctgactcagtctctcccagccttttccattctgcctcttccccttgttgtccctgggtcttctatctgctctcagtccatttgcccatccctgagttcttcctgccctgccccagcaccttctcctctgcccctctccaccagccctgcagatccctgggtcctttcttgagcctcaggaactcaccttccatctcatcttccctgaagaatgtcactgctgagcctgtcctggctgggtctcaggtgagtggcagcatccccttgactgctcctgctggctcctggtctggacctacactttctatgacaactgctggtatctctagtgttttctgtagcctctgatttggaactggtttggaggtcacctgggcctggtgactgtagcagcaggctggctctaaggtctcagagtagatcgacttcctgaggggccaggagtggagctctgggagttggggtgagggcatgggctggcatctgggatggcagagaagtgaggaaggtggcttattcattcctctgctgtgccactcaacacctttgtcacctccttgttctctcatcctggcccatatcactcccttcctgcccatgttcctcacattcttgtacccctgaggggctccatggttctgcatagagcatggaacccctggcgtttctacattgatcactactggacttgaagcctcctgaggggcatggtccagtgccttggcccattttctgttatgggacacatgggctggaagagcagtgtgtgtgttctccaccctccctcccagagcatcaagctcttatcttgcctctgctcactaagatgtccccgtgtgtcctgttgcagaggctgaacgaaagctggccactctcttcccctttcagagccttctttggtcttccttccctcctcagacctctgagtcacatctgctctcccattttgggggtgtggcctcagcccatttgtaaatggtaggattgatgggcatgccagttgcagtgggagggtgcacagcacgcactagtgcagagcctggcatgcagaaactgctcccaggtgggagctgccatcctgagggacagttacaatcaacttgtctccactggaggctgctgagaagggaaggtccctggtgtatagaccctgctccctgaggaatcagagctcatggacacccacaaaaacatgaaaggatgtgggttcacatcctgaggccacactgcttaccacagtctcatatggctgtccctgggttgaaaccaaccccaggataagaaaatcttttcctgtagccaaggtgtgtctccctgttggaagagtcttctctccctgctcttggctgtacccttaggtattggaggtgtccctgagagaaaagaagtaggaggaagcagagattccctggatttctacacaatccagacctgctgttcattcggagtctggtccttccacagaggctgcagagggaacctgtgcattactcatggttttccttaatccagaatcaataggatatatttatatctactacctatctatcatttgtcaactatccatccatctctatacctatctacctatctatctgtatccatctatggagagacaaaaaaaaagaagagagaaaaaagaattgactgtggaaatgggctcatgtgatcatggaagtagagaagtcccacgatataccatctgtgggctgcaggaccggggatgttgggggtgtaattcagtctgaatccaggggcctgagaacctggacttttgatgtccaaaggcagaagatggatgcccgaaggcagaagatggatgccccagctccagaagagagtgagttctcccttccttcaactttttgttatattcagcttctcagtggattggatgatatgcgcccacattggggagggcaaatcttccttagtttactaatttaaatgtgaagcttttctgaaacaccatcctagacacacccaaagattgtgtttgaccagtgatgtgggtatccctcagcccaggcaagttgacacctgaaattaaccctcacagaatgtgactgtccctgctttgcatgcaggtcacccccacagagcaaggcttgaggattctgactcagctggtggccaccttcacatgaggctttatgaggtggacaggtctcatctttcctatcatcagtttgtgccccgacattggccatcaatgctacaggtgcccatgcagagcttgtggtggtgggcaccatggcacataagagggcttctagttctttcaatcccaagcttttatgaggcccctgcagtgccccacccctcctttcctctcctctctcagctttcttcctctttcctgtgtattcggcaacctccaactccatggctcccccatccactgctatcatcccctgccctcgtgttctgggtactgctgggtcctaagtggcctgaatccaaggccccatcctggaggaactcctaagtctgagaaggtgaagctggacaaagacatctccaatttcacgggggtcagaaatggagctaagggagatgggctctgagaaccagaggagaataaggtctctgtgggggcaggctggaaggctttttggaggaacggttgctggagcagggcctggaatgatgactaggaattgttaaatcagaaggcagggtgattccacgggcatcattagtgtcccaggccccctgccaggactaacattggcatttccagtccccacacccagaacagtagaaggacttgtggctgctggaggatctgggttgctgtttacatagcatccaggtctggtgggtcagtttcttctacccctacctgtgaaccttggtctcctgccacaggcaccaggaatctttaataggagaccccttcccagcctgctacacttccctgggagctagggactgtacagccacaccgggcccagcgcagggcctgttgggaaggcactggcctccagggtatgaccccggcctcctatttagcaacactgcttttttcctccggcctgcctcaatgtcccagtgaaagcctgcaagcctggcgtcctgtccctgtcacccggggaggcttcttgccactttggggtgctccccatgggcgagacacgcaccctggggtggcagccagggactccatggcccccccgggtctggcccaaggcctgctgggaaggcactggcccccgggggaggacagcagcctctgcttcgctttgctgcctttttaccttggcctccctcaatgtccccctgaaagcctgcaagactggcatcctgtttccgtcacatgggggaacttcttgtcgctttgggatgcccccacatcggagtgacatgcaccctggggtgaaagcaaaagactccacggcgccccgccctcaggtctggcgcatggcgtgcaaggaaggcagtggtgtccggggtaggaccccagcctcctatttggtctcgccgctctttttttccatgtcctgcctcaacgtcctcctgaaagcctgcaagcctgatgtcctgtccctgtcacccagggggaatccttgctctttgggatacccccatggcagagacacgcaccctggggtgggaaccaaggactccatggccaccccgggtccagcgcagggcctgccgggaaggcactggcctccgggggaagaccccagcctcttcgaactcgctgcttttttcccctggcctgcctttatgtccccctgcaagcctggcgtactgaccccatcacccggggggacttattgcctctttggggtgctctccacgcacccttgggtgggaactagagactccatggccttctctgatcccgcgcagggcgtgccaggaaggcactggcctctggaggatgaccccagcctcctcttcagcctcacccctttttttccctggcctgcctcaacgttcccctgaaagcctgcaagcctggcatcctgtccccatcacctgcggggaagcattggggtgttccccacctaccgtggggtgggagccagggacttcacagctcccccacccccctgtctggcgcagcacctgctgggaaggcaatggcctgcgggggaggaatccagcctcctattccgcctcgccgcttttttttcccagccggcctcaatgtccctctgaaagtctgcaaacttggcgtcctgtccccatcacccggggggactccttgctgctttggggtgcaccccacccaccctgatgtgggagacagggactccacggcccccctgggcccggcgcagggcctgccgggaaggcactggcctccgggagaggaccccagcctccttttcggccttgcaggttttttgccctggcctgcctcagtgtccaactgaaagactggcgtcctctccccgtcacacgaggggcttcttaccactttggggtgccccccacgcaccctggcatggaagccagggactccacgaccccccgggtccgacgcagggcttgcggggaaggccctggcctccggggatggactccagcctcctcctcagattcgcttctttttttccccgccctgcctcaacgtttccctgaaagcctgcaagcctggcgtcgtgcaatgtcacccgggaggacttcttgccactttcgggtaccacctgtgggaaaaacaggtaccctggggtggaagccagggcctctacacaccactctgccaagatctggcgcagggcctgacgggaaggcactggcctccgagggaccaccccagcctcctcttcggcctctccgccttttttccccagcctgcctcaatgtccttctgaaagcatgtaagcctggcatcctgtctccgtcacccggggcgacttcatgccgttttggggtgccccccacgcaccctggggtgggagccagggactccattgcttccagggtctgccaggaaggctctggcctttgggggaggaccccagcttcctcttcagcctcgtcgattttttcctcggcctgcctcaacgttcccctgaaagcctgcaagactggcgtcctgcccccatcactcggagaaatttcttgctgctttgggtgcccccccgtaggagagacacccaccctggtgtgggtgccagggagtccacggccccccacgggtccagcgcagaatctgatgggaaggcactggccttcaggagacgacctcagcctcctcttcggcctcgctactttttatccatggcttgcctcaacgtccccctgaaagcctgcaagcctggcgtcctgtccccgtcacccagggggatttcttgccgctttggggtgctcccgtgggagagatgtgcaccctaggatgggagccaggaacaccacaacccccgccccggtgaacagggcaggactagccgggacggcactggcctctgggggggacgatcccagcctcctcttcagcctcgccactttttttttctggcctgcctcaacgtccctctgcaagcctgcaagactgacctcctgttgctgtcacctggggggacttcttgtcattttggggtgcccctcacacaccctgagatgggagccagggattccacgtcccccttcccccacccggtccggcgcagggcctgttgaaaaggcactagcttccaggggaggaccccagcctcctctatggcctcgctgcttttttttctcggtcggcctcaatgtccccctgaaaacctgcaagcctggcatcctgtccccgtcacaccgggagactttttgccgctttggggtgcccacaacccaccctggcgtcggagccagggactccacattccccccacgagtctggcgcagggcctaccaggaaggcactggcatccaggggaggaccgcagcctcctctttggtggcgccactatttttccgcggcctgtgtcaacgttttcttgaaagcctgcgagcctggagtccagtccccctcacttgggggtaattcttgccgccaaggggtgccccgcttgggagagacacgcaccctggggtgggagccggaaactccaccgattcccgggtccgacgcagggcctgccaggaaggcactggcctccaagggatgatcccagcctcctcttcggcctgccttaacgtccccctgaaagcctgcaagcctggtgttctgtccctgtcacacgaggggacttcttgccgctctgcggtgccccccaggcaccctggggtggaagctaaggactccaatgtaccccaggatccggcgtagggcctaccaggaaggaagtggcctccgtggaaagaccctagcctcctcttcagattcgctgcttttttcccccggcctgcctcaacgtttccctgaaagcctgcaaggctgacatcctgccccatcactctgggggacttcttgctgctttggggtgcaacgtgtggcaaagacaggtaccctggtatgggagccaaggactccgcagcaaccccagatctagtgcagttcctgctgggaaggcactggcctccgggggcaccccagccacctcttcagcctcactgcttttctttcccggcctgcctcaacgtccccctgcaagcctgaaagcctggcgtcctgtccccattacctggggggatcttctttccactttggttgccccacacacaccctgggtgggagccagggactccacggctcccccgggtatggcacagcgcctgctgggaaggaagttacatccacgaccctagtctcgtcatccgtctcactgcttttttccccaggtctgcctcaacttccctctgaaagcctgcaagcttgatgtcctgtacccgtcacccggggagacttcttgcccattttgggtgccccccatgcagcctgaggtgggagtgagggactccacggctcctcagggtccacgcagggcctgctgggaaggcactggcctctaggggacggccccagcctcctctttggcctcaccactttctttctccggtctgcctcagtgtccctctgaaagcctgcaagtctggcctcttatccccgtcacccggtgacactttgtgccgcttttgggtgcccaccacggaccgcggggtcagagcgaggaactccaaggctccccagagaccggcgcagggccagctgggaaggcactggcttccggtgagcgacctcagcttccattttggcatcgccgcttttttccccaggcctgcctcaacgtccccctgaaagccggcaagcctggggtcccgtccccgtcattcgggaagacttcttgccactttggggtgcactttacgcaccctggggtgaaagccagaaactccacggccttcccaagtctggggcagggcctgctgggaaggcactggcctctagggaaagactccagcctcctcttcggcttctccactttttttctcctgcctgcctcaacgtttccttgaaatcatacaagcctagtgtcctgccccgtcaccgggggggacttcttgccgccttggggtaccacccgtgggaaagacacgtatgctggagtgggagccagggcccccatggcccccatgaatctgccgcagggcctgccacgaaggcactggcccctggaggacaaccccagcctcctctttggcctcgcagtttttcttccccggcctgcctcaacatccttctgaaagcctgtaagcttggtgtcctgtccccatcatccaggaagatttcttgccgcttttgggtgccccccacccacactggggtgggagcgagggactccacgactccccagggaatggcacggggcctgccaggaaagcactggcctccgggggacaatcccagcttcctcttctgcctcgtcgcttttttccctcggcttgcctcagcgtccccctggaagcctggcgtcctgtatttgtcaccctatgggacttctagctgctttggggtaccctcgtgggagagactagcactcaggagtgggagccaaggaatccacagccccccaccccccgttaaggtgcagggcgtgccgaaaaggcactggcctccgggggaggactccagcctcctctttggccttgccgctttaattccctagcctgcctcaacgtccccctgaaaggttgcaaggctggcgtcctgtcccggtcaggcggggggagttcttcccgcttttgggtgggccccacacaccctgaggtaaaagccagaaactctacagccccccagggtcccgcacagggcctggcaataaggcactggcctccgagggaggaccccaacctcctctttggccttgccccttgttttccctggcccgtctcaatgcttccctgaaagcttgcaagcctggagtcctgtccccatcacccagggggacttcttgccactttgggttgccttccacgcaccctggggtgggagccagggactccacgcacccccccgcccccagtccagcacaggtcctaccaggaaggcactggcatccaggggaggaccccagcctcctcttcagtctcgccactatttttccgaggcctgcctcaatgttttcctgcaagcctgcaagcctggcgtcctgtccccatcactcagggggaattcttgccgccgaggggtgccccacgcagcacagacacgcatcctggggtggaagccggaaacgccaccaattcccgggtgcggcgcagggcctgctgggaaggcactggcctacgggagatgaacccagcctcctctttggcctcgctactttgtttcccggcctgccttaacgtccccttgaaagcctgcaagcctggcatcctgtccccttcacccgggggtatttcttgcctctctggggtgccccccacgcactctgaggtggaagccagggactccacggtaccacagggactggcgcagggcctgccaggaaggaactggcctccagggaaagatcccagcctcctcttcggagtcactgcttttcccccccagcctgcctcaacctttccctgaaagcctgcaagtttgacgtcctgccccatcacccagagggacttcttgccgctttggggtgcaacctgtcggaaagacacgtaaccccggtgtaggagccaaggactccaagctccccgctcccttcggatccagtgcagttcctgccaggaaggcattggcctctggggaaggaccccagcctcctcttctgcctgcctgctttttttttcttggtctgcctcagcgatcccctgaaagcctgcaagcctggcgtcctgtccctgtctctcgaagggacttcttgccgccttgtggtgcccacgaggcgccctgggttgaaagccagcaactccacagcaccccgggttcaggcgcagggcctgctgggaaggcactggcttccgcgggacgaccccagccttctctttggcctcaccgctttttttccccaccctgccttgttgtgaccaagtgagttatagagaaacgccacattttgagacaaattaaagagtcctttaatagccggcgaccgagaggcagctaactttcaaaattctcttggccccgaggaaggtgctagttttgtttttataccgtggtctaaataggggatggggaattttagctgaagcaatttttacaggagaactggcaaaaagttaaaaaattaattggttacaaatgcagttacaaaaaataaacagttccaggtgcagaggcttaaactaccacaaagagataaatgcaggggttttgggtgccatccaccgagcgcatccccaggagctgctggtgcagcttgcctcaatatcttatcagtagatgcattcctggatgtgctttgagtcagttttacactagttatgccttaagggagggcggtgaaagggggttgcaaatgaagaaactgaaacggaatctgttcggctctctctctgctaggagagagtcactcagttaaaaaaaaggtagggtatcacattccccactcatgttttggggaatcaaatcattgattcttcagttataccaagggggttatactcggttctgagatacataagtttgacagaagctatgcactgttttacaaagttaaggaaccaatttaacatacaagtcctgaagattaaacttaacaagaggaggagaaggggtcctgccagtacagtaatcagaatagttagccatggattccagttgaacatgctttgataccagggggtgttactttctcgttcttgttggagtctatctatattttctcgaactctttggagggtatcttttatgactccagactgattggcatagaaaaagcaacactctcctagggctgcacataattctccttgggaaggaaatagtagatctaagccttggtggtttttgaagaactacttcagctagagactctacctgggtatgtaacatatttatggctgactagagattgcttaaatcagcatctacttgctgagacagggacattaatccagtttctccctgaactagggcagccatgccaatgcctgctgacccagctatgctaaggctagctaggaggggtactaagagtggggcagcttggcgaaacttggaaggcaattcagggggagcaataagaagttctccttctggcccactgtacacatagacctggcggagtacatgaactaacacacacagaagaggtccatgttcagtcccattgatgcagtgagtgaggcctgaagtacaagccaaccaggtgttgttaggtgcctggtaggaaactgaggtgtttaaggaagtaagtagcgattgattacaggtggcctgaaagggagaagcagataagttatacccattgctaattagacaggaggcattcccctacatgtctcctaatgtaagggcatggggtcgtgtatgacaaaagagagagttaaccttgaacatggcctctactcctaaaccaacattatatggggattttgctgtcaggcacaaccaacaatcttgggctagttttggctgggtgaggttaaggaggtgatgcactccatccagaatggacatcaggccgggttggagatgctgtcgttgtaattgggatttaggaaccaagagtggtgggacagttaaatcgaccctgtctgggtgtttttggaacatagggtcacctaaatcagttagaggtccgattggcttaggagggctccacgggaccaggacatttttctgaatggtgaacatagttccaacatcaaatcctgagatataaagtcttaatccccattacatgccataataccattgagctgaattagggttacggacagttataggaagagggttgcagttccttagagtgcacggtctaggacaggaagagcgagttatggagagggttgaggactgggttgatcctccagagtaagtggccagggttacacacaagcagttagggcagaaaaactgataggaatctcaacaactgggtcagggtgatttccagtacaggggtaaaaatcaacgctctggagtcctttttctgcacctttagagctccctcatccagtccggcttcctgtgtgtccgaatcctgcagccaggtcaatgtttcctgctcctatgaccagcagattgcattgcttttcatgggtatgggcaggctctgggaataagcacataaatcaactgcaaaagagacttttttggagcttcctgccttccaagtagtgtttgcaaatacacgtcctgtcatgaaagaagtaaggagaaaagagtaggatggagcagaaggcatgacaggcgggaacacacaaaagaggtaaataaaaggaattaatttgatggcttcaagtgacttaggtgcagttttaaggggcctggcccaggcttggggatccatgtttcttgctgggctttgctagcctttttgatgagagagtgatgaatccaggcaggaatgccatccacctttagagctgtcagcgtggtgaggatgacagtatgagtcctttccaggcaggaatgaatccttctttctggaactttttatcgtacaccaggtcacccggctggaaagagtggcagggtcccatctggtcaggaactggatttgggcgtgctccctggacaagtgcctggatgatgtctcgtacctgttggagagactgcatgtactgtaataagttagcttgagagatttctgctaaatgagtgtctctcaacctaggcaggataggtggagcccttccatacataatttcaaaaggtataaacccagctcagtaaggggtgcatgttactctaagaagggctaaacgaaggattctcacccaattctcacccatttctagaatcaattttgtaagagtattttttagggtgtggttcatgcgttctatctatccagagctctggggtcggtaggcacaatggagtttccatttgatgtttaatgccttgctgaccaactgatgtatggactaggtgaaggctggcccattatcagaccctatggcaacaggcaacccatgtcttgggatgatttcatttagtaaaaacttaactaccctagtggcagttttgtttctggtggcaaatgcctcagtccacccacaaaagatgtctactagcaccaggaggttcttataccctgcccagtgtggtttaatttctgtaaagtcaatttcccacctttctcctggtgagtctctgcagagatggtggcctgggctgggtttgggaccttgcttggcatttacctgagcacaagccatacactggagagctgcttggttagctaagtcctgagggtgggggatcttgaaacagctccttagaagctgggccaattttactcctcccaaatgggtggtagaatgtagacgattgactagagttttcccaagggcttggggtctgaagattctggaatcaggaataatccaccaaccttcctgatttttattagcctaaagatctgaagcctgtttgtcttcttctgtggagtattttgggtgatttggcaagtcaggctgcagaaaagacatggcgggcagtaggaccaagggcacgactgagagctgaacagcttctcggggctgcagagtctgctttggttaccacgggcaatggctgtgttttctctttgatgtcctttgcagtgaattacagccacctgctgaggaagccaaacagcttcaagaaaggctaaaatttcttctttgtttttaatagactttcctgctgaggtgagtagcccatgctcttgacagatggctccatgtacatgtacagtagcaaaagcatatctgctgtcagtgttaatgttaatacatttgtccttaccccatgggagagcctgagtgagggccatcagttcagccttctgggctgaagtatttgctggcaatgcctgggcccatagcacatccaactccatggtaatggccgcaccagccttctgtactccttgttcaaggacgctgctatcgtctgtaaataaggtgacctccactttctttaggggcacatcttggagatcaggtcggccagttttggtagtttctaacagttcctggcagtcatggacaggtgtagtgaactctggatcaggaagtaaagtagctggatttaaacaccttgtgggagagaagtcaaatgaggctgatctaacagtaaactctgatactgtaggatacgagcatttgacatccatttgctagaagcactttgtagcaaagtctctacagcatgtggagctgtaagggttaaattttggcctagagtcaatttgtcagcctcttggactaggcttgctgttgctgccatgactcacagacagcttggccatccagaggccatagggtccagtctctcagacaaataggctactgggcgtctccagggtcctaaagtctgagtgagcgcccccttagcaactccctggctttcatgaataaaaaggtgaaatggttttgagatatcagggagggctagagcgggggcctcagttagtgcctttttcaggtttttgaaagcctgttcttcagtgtcagtccaaactagtgggccattccttccagtagtggtgtacaggactttggcaatttctgcaaaccctaatatctacaggcgacagtatcccacagcccccaggaattcacgtacctgtcttttggtggtgggagtggggattcgcagaatggcttccttataagcactggtgagtgcccattttcctttatctcataccctaggtaggagactctgtgaagacaaagctgggcctttttggctgagactcgaaacccgagttcctgaaggaggtaaagtaagtctctagtatgttgcaggcagctgtcagaggtttcagtagctaataaaaggtcatctatgtactgaagaagggtacaattagggtgtctggctcaaaatggtacaagatcctgttggatggcttccccaaaaagggtgggggaatttttaaaaccttgaggtaaccgagtccatgtcaattgggtggtgtctccttagccaggatctgtccattcaaaggaaaatataggttggcttttgagggccagaggaatagcaaagaaatcatcttttaagtcaaggacagtgtacactgtgtgttctggtgggagcaggctgagtaaagtataagggttagggactgtagggtggacagtgactgtccatctgttaacttcctttaaatcctgtacaggctggtagtcatttgttccgggtttttggaccagcaacaatggagtgttccaggtggactgacatggtgtaagtatgccagcctgtaacagttgctgaatatgggggttgattccttccctagcccattgactcataggatatgctttacctggactggcaaggcagtggccaggagttctactaccactggcggatggtgcttagccagtcccaggaggtttgactcagcccagacctgaggaaagagagtctgtaagcccagtaagagaggattagttttattctccagtggttgtgaaggtgaaactaagagatattcttctgacagaggggtggttagcaggagctgagcagtgggaggtgttgtgtctcttagcatgaggtgagcttgttgggctgagatggaaatagatgcctgcagcttgtggagcatgtctcttcctaggaggggaaagggacactctgtgaccatgaggaatgagtgggttactcttttctgtcctaaactcacctcttgtgagtgggtgacaggatattcttgaatcactccagtagccccttgtacagcaactttcttattagagacactgcctagcggaatctgcaataccaagtgttccaccccagtgtcaattaggaagtgtacaggctggccccctactgtggcggtcaccatgggctcccaggggccaagtggaaaggagccctggccccgtcactcatgagattcctccacaaaagggagggtgaggacttttttctcttctggtttttcctctggtcttaacgggcattcctttttccagtgtcccatctgcttgcaataagcgcattggtttttctccaggggagcccggtcccctttctggcttttttggtggggacctggggttccctgaccatttttctgtgacaggggcttttctttcttgacttcatgaatggcagccactatgatttttgcctgtctttttgatgctttgtcagcaggcttttcagctgcctgagctgcctgtttctgcttttcaaactctcagttgtcaaaaaccttttgggctatctctaaaagctgactgatgttcattccagcaaatccctctagcttttgcaattttcttttaatgtcaggggctgcctgagccacaaatgccaaattaagagcacagctattttcgggagccattgggtcaaaaggggtgtaagtctgataggcctcctggaggctttcctaaaatgctcctggtgacttgtcaggcccctggacaacttcagttgtcttagacaaatttatgggtttttgagtggctcctttgacacccacaaggagataccggtgaaaatcgtctaaggctctccttccacctgaggaatttgggtcctaattaggctgggtagagggaaaagcctcttcaatttggtctcaggcttcctcttctggcccaccagctgatgtaaggtaatactttctggcctcccttcccatacactccctctcttcagaggtgaaaagggttaaaagtagttgctgacagtcctcccaggtgcggcagtgagtctggagcacggactccattagtgaggtcaaaacctgtggcttttcagaaaaagggggattatgaggcttccagttgtacaggtcagaggtagaaaaagggacaaactaagaagggagctgagtgctctctcccaaatattttgggtctctctcagtgggaggaggggggctacctcctcctgccttggccacaatcgggaagctatgggtggagagcccacaggagatgtagtcgaggaaacaagggaagaatccgggggagaaggagggttatagggtggcagaactgggagaggaaaactttcctcttcctcagaagaaggcagtacaggaggagccgaggggactcagggtcagggtaaaaatgtggaccggctcaaaaggaccctggaaatgggatcatgaatggcacatgagtggagccagggaggagggccccgtaccaaatccagccactgatcaatgtagggaaactgattggggtgaccgggacttccagtaatgacctgccacacatcctgaacacatgtggggttaaatgacccttctgtgggccatctggttccaaactgtggccattctacttcacagagtgtccagagtttgcctttcttcaggcagactccataatcttctgagaagtctacagagaaattctgcagtatacattggagaggactctactctttacagggccaggaagaggagtttcctattttggaggcagtttaacaaggttgaacagagatattaaacccagcatggacagagaaattcacaacctgggggactggcatattggaagaagggaaataacacaaccagaaagagcaggaaaaccactacagctaagacttcctgccatatgaagtaggttttcttaagcttcaagatttaggggggaagattagcaaccaacccgaggcctccttggctggcaggacctagatgacctccttccttcccttgacatatagcccaggtatttttggtgtctccatgattcaaagacaaaaagttcaaactcggccctttctttcaagggttttaggagggagagcagggctaaatcttggaggctctggacttgctgtgacacaggaaaatgagatgtgtggggaagggataaggatgagggggaaagggcccacttggatctctcctaaggtaggagagtagccaccggggaacagaataggagtccagatggagtaaagcagtatgagcgtaggcttctctgcacagtcttctattcaaaggcacgggaaacgttacaggatgacagaaaaggtgggcaaggaggcctgcagggtgactattttggatccaccactgatctaatcgggaggctgtccagtcactagagtgtgggatgtggcaatctaaattccagcagactttatggtgccagaaattccaaatgggcgagtgtttcccacacttcttcccgtaacaacacttgatttctttctgacagaaaaggcaggactgggacggccagcccaaatgactgatgaggtatttgacctcctgtggtagaaaatcagcactgaggaccttgaagaatttctttcctagttgccttggacagcactggcgacctgactatgaaacttagactgacactaaacaagacaatagacaccgagcaggacaataaacataaaacaaacaacagaccctagggtataagaacaattatggcagtttttattaaatagacaaggggagggggtccggtgatgggatcagtcagatgcccgcctggccactctccctgaggggacttgggctcctcttagcattggcaggctggtataaacccccggctcggatcgagctatgctcagtgctgccttaagccttatgaggtcaccatggaactacaggtgcgggcccactcgaactccatagcttttgccgtggagctacaaactggaagttcaagtgcaagcccttgacttccccatccactcaccattcacacaaagtttataatagtttttttttttttgccataaaacagaagtcttatggaaacctgaacgtgaaagggaggagagatagagaaagagagagcagagagagagacagagagagagagagagagactagtctttaatggagaggccagcctgccagaaaccaggactcagtcctccagcatcctggaatatggattgagtcaagggagggcccccgtcagggccgcttccctcccagagagacacagaggcacctaacagaaaatcaggactctgtcctccagtgtgctggaatgcgggcagagtcaaagagggagggccctgtcagagccatttccctcccagagaaacagagtcagatatgacttaccttcccgggaccagaggactcaggagttgaatttttctgggcacacaccagtggtcgatccattcccctccagaagacagggtcttatggggccctggaacgtcttcagggggcgcctcccctataagtccactgtctgtctgggggaacctggaatgagtccggctcttgcccagtggcgaatatctcactggggcctccaaatgttgtgaccaagcgagttatagagaaacgccacactttgagacaaattagagtcctttattagccagtgaccaagaggcagctaacgctcaaaattctcttggccctgaggaaggggctagttttgtttttatactgtggtctaaataggggaggggggattttagctgaagcaattttttacagaagcagaactggcaaaaagttaaaaaattaattggttacaaatgcaattacaaaaaataaacagttccaggtgcaggggcttaaactatcacaaagagataaatgcaggggtcttgggtgccatccacccgagcgcatccccaggagctgctggtgcagcttgcctcaatatcttatcagtagacacattcctggacacactttgagtcagttttacactagttatgccttaagggagggaggtgaaagggggttgcaagtgaagaaactaaaatggagtctgttcggctctctctctgctaggagagtgccactcagtttaaaacaaggtagggtatcacagcctcaacgtccccctgaaagcctgaaagcctggcatcctgccccatcactcggaggggggaacttcttgctgcatggagtgccccccaagcaccctggtgtgcgagccaggtactccacggccctccagggtctggtgcagggcttactgggaaggcactggcatcctgggaaggaccccaacctcctcttctgtctagctgctttttatccttggcctgcctcaatgttcccctgaaagcctgcaggcctatcgtcctgtaactatcaccttgtgggacttcgtgccgtggagtcccccccgtcacctccgggagagagacatgcaccctggggtgaaagccagggactccacagcctgcccatgtttagcgcagggcctgccgggaaggcactggcctcgggggggatgaacccagcctcctcttctgcctcgctgctttttttcccccagcctgccacaacgtccccttgagagcctgcaaggcttgcgtcttgtccccgtcaccaggggtgacttcttgtcactttggggtgcccgccacgcaccttggggtgggagctattcactacacggcacccctgggtccactgcagggcctgccagaaaggcactggtttccgacggaggacccaaccctcctcttcagattcgctgcgtttttttcccgacctgcctcaacatccccttgaaagcctgcaagcctggtgtcctgacccatcaatccggggaaatttcttgccgcttttgggtaccacccataggaaagacacataccctggcatggaagccagggactccatggccccccggatctggcccaggacctgccgggaaggcactggcctccaggagatgactccagcctcctttttgccctcgacgcttttttttctctggcctccctaacgttcccctgaaagcctacgagcctggcatcctgcccctgtcacccagggggacttcttgacgctttggggtgctcctcatgcacgccggtttgggagccagaaactccacggccaacccctgttccagtgcagggcctgctggagtcactggcctcatcgggacggcaccagcctcctttcctgccttgctgctttttttccctggcttgcctcaatgtccttatgaaagcctgcaagcctggcgtcctgtccttgtcacatgcagggaattattgccactttggggtgccccccacccaccctggggtaggatccagggactccacggccctcccgggtttggcgcagggtccaccgggaaggtgctggcctccagtggacaaccccaggctcctattcggccttgccactttttttcccctgcctgcctcaacgtccccctgaaagcctgcaagactcgcgtcctctccctgtcacccgggggaatttttgtctctttgggggtgcccataatgcaccctggggtcagagccaggaactccacggccccctcaggtccagcacagggcctgttgggaaggcactggcctcccttggtcgaccccagcctcctcttccgcctcgctgcttttattcccccgcctgcctcaccgtccccctgaaagtctgcaatctggcctcctgtccctgtaacagggggtgacttcttgcctctttgggttgcctcccacgcaccctggggtggaagccagggactccacggccttcctgagtctggtgcagggcctgctggaaaggcactggcctctgaggggggaccccagcctcctctttggcctcgcctcttttcttctctggcctgcctcaacgtccccctgaaagcgtgcaagcctggcttcctgtccgcatcactcgggtggacttcttgctgctttttgttgcccccactacgtatcttggggtgggagccagggaccccacgaatcccccaagtctggcacagcatgcccagaaggcaatgtcctccgggggaagagcccagcctcctcttcggcctcactgcttttttatccaggcctgtctcaacgtccctctgaaagcctgcaagcttggcgtcctgtccttgtcatccgttgaggcattttgccggttttgggtgcccctcacacaccctcaggaggaagccagggacttcccggcttcccagggaccaatgcagggcctccctggacggcactggcctcagggggaaaactccaacctcctcttcggggcctcgccgctttttatccctggactgcctcaatgtccgcctgaaagcctgcaagcctggcgtcttgtctgtcacccggggagacttcttgccgctttggggtgcccccggtgagggagacgcacactggggtgaaagccagggactccacggcccgccatgttctgtcgcacagactgccaagaaggcacacacctccgggggaaaaccccagcctccttttcagcctccgctttttctccccagcccgcctcaacgtcccccgaaagtctgcaagcttggggtcctgtccccatcacccagggggacttcttgctgctttgggttgcctcccacgcaccctgggttgggagccaaataatcaacagcactcgcgtgtctggtgcaaggcctgccaggaaggcactggcctcaggggagaaccccagcttcctcttcagccttgccgcttttttcctggcctgcctcaacgtccccctgaaagcctgtaaacctggcatcctgtcactgtcacctggggaaactttgccgctttggggtgcccaacgtgcacccgtggagccagggactccacggcccctccgcctctggcgcagggcctgttgggagggcactggcttccggggaccacatcctcctcttcggtctcaccacttttttcccctggcctgcctcaacgtcccccctgaaagcctgcaagcctggcgtcctgtctccttcatacagggggacttcttgctgctttgtaatgccccccacgcaccctggggtgggagccagggactccttgccaactttattctccggcctgaatcaacggcccacagaaagcctgcaagcccggcgtcctgtccctgttacccgggtggacttcttgctgctttgaggtgcaccctgtggaacagacacacaccttggggtaggaaccagggaattcacacaccccccaccccctccctgggtccggcacaggttgagttgaacagcctgcggaaaaggtactggcctctgggagaggacccccaacctcctctttggcatcaccactttttttccatggcctgcctcaatgtccctttgaaaggctgcaagcttggcgttctgtcatcacgcagggggacttcttgctgttttggggtgcccccatgcaccatggcgtgagaatcagggactccacggccaccccgggtctggggcaggacctgttgaaaaggcactggcctccagggaaggaccccagcctcctcttcagccttgccacttttttttccctggcctgcctcagcgtccccctgaaaccctgcaaggctagcatcctgtaccagtcacatagcgaaaattcttgccgctttgggatgttcccccaaaccctgaggtgggaggcagggactccacggtcctccctggtctggtgcagttcctaatgggaaggcactggcttccggaggatgactcctgcctcctcttgggccttgctgctttttctccccagcctgcctcaatattcccctgaaagttcgcaagcctggcttcctgtccctgtcacccacagggacttcttgccactttggggtgcccccaggggagagacatgcaccctggggtgggagccaggaactccatggccccctgggtccaaagcagggcctaccatacaggcactggcctccaggggaggaccccagcctcctctttgttctcaccacttttttccccatcctgcctcaatgtccctgtgttggggaaaggctgagtgttgggaaaaaaactgaggcagggcttgcatgtgtgacataatgtaaaagggtcttggaacatgtccggggtccagggtctaaaaccccttatggcctttggaacaccaagctctgtgccaaagggtggaaggctgccctgccacaccataatctaagccctgggcatgaaaccactcgtggcttgcatagaatccaggacttagggcataaaacccctcctggcttctagaatgtgtctagacttgctggctccttgcttctagcactgctattatctcaagcagcagaacttgttccatatgcttcaaagaaaatactaaatcatcacagctgtagatcatgtgcaacccccctacatcctcgccacctgtttctttgtttgatcaccaatgaatagggtgggatcccagagctaggggccttcacatcctccatgctagcattggccccctgatcccactttatgcctttacttgtcttttctcattcctttgatttggccggacctcattgcccccacagctgggtgttgggtttgatcacctcaacagccctgaaagcctgcaagcattgcaacctgttcttgtcatccagggagacatcctgccacttaggggtactgcccatgcaccctatgatgagagcaagaaactccacggcatccctgggtccagcacagtgcctgccaggaagacactggccactggagaggatcccagcctcttccgccttgtcactttttctccccagcctgcctcaacatccccctgaaaccctgcaagcctggcgtcctgtccccgtcacctggcaggacatcttgctgctttgtggtgcccccaatgcatgctggtgtgggagccggagactccaaatctcccctgaggcactggcctctggggcaggaccccatcctcctcttctgcctcaccactttttttcctctgcttgcctcaacatccccctgaaagcctgcaagcctggcgtcttgtccccgtcacctgggggcacttcttgctgctttgttgtgccccctgtgggaaagacatcaaccctggtgtgaaagccatgggctccatggccccccagttctggtgcagggcctgataggaaggcactaaccttagggggatgactccagcctcctcttcagcctcgccactttctttccctggcctgcttcaaccctggtgtgaaagcctaccggaaaagcactggcttcagggtggggggaccccagcctcctctttggcctcacctctttttttccccagactgcctcaatgacctcctgaaaacctaaaagcctggcgtcctgtccccatcacccggggggcacttcttgccgctttggggtgccccccactcaccctggggtgggagccagggactcctctgcccgccccccctgttcagatgcaaggcatgctgaaaaggcacttgcctttgggggaggaccctagtctcctctttggccttgccgcttttttcccttggcctgcctcaaagtccccctgaaagcctgcaagcctagcgtcctgtcccgtcacctgggggaaattattgcccctttggggtgccacacgcaccctggggtggaagccagggaccccgtgccccccccccgggtcggggcaggccctgccaaaagaaccccggactcagagggaggatcccagcctcctcttcagccttgctgcatttttttttccggcctgcctcaaggttcccctgaaagcctggccgcctgtccctatctcctggggtacttcttgcctccttgtgctgcccccgtggggagaggaacatgcccttgttgggagccagggtctccacaactcccacgggtagggcataggaactgccgggaaggcactgacctcctgcgagggacccctccctcctcgtcagcctcgccgatttcttcccatgcctgccgcaacctccccctgaaggcctggcctcctctccttccacgggggacttcttaccactttggggtactccaggaggaaagacacgcaccctgtgtgggagccaacaactccacgaagcccctgggttaggcacgaaggctgtcgggaaggctttgacctctgatgggggatcctgacatcctccttggcctcgctgcttttttcctgggccttcctcaacctccccataaatgcctggctgcctgtccctgtatcccgggggacttcttgctgctttggtgtgcccccgggggaagagacacgcaccctggttggcagccagggacttcacgacccccctcccccaggtccggtgcgggggctgccgggaaggcactgacctctggcgggggaccccggcctcctattcaacgtcgatgttttcttcccgggtctgcctcaacctccccctgaaggcctggacgcctgtccccatcccccggggtacttcttgccactttggggtgccacaggaggggagactcgcaccctgggtggtagcctgtggcttcacgaacctccctcatgttggtcgcgggggctgccgggaaggcaatgacctccagtgggaaaccacgacctcctttttggcctccctgctttcttcccaggtctgcctcaacctcccccgaaggcctggccacctgttccattgccctgggggacttcttgccgctttggggtccccatggggggacctctgcactgacccctggcaggggaccctggcctcctcttcggccttgccgctttctttccaggcctgcctctacatcctcctgaaggcctggctgactgtccccctccccctggggtcttcttgctgctttgggttgcccccagagagaaaacatgcaccttgggtgggagccagagactccatgaaccccttggttgggcacggagactgtcgggatgggactgaccccaggcaggggacacaggcctcctcttcgacctggctgcttttctcccaggcctgcgtcaacctaaccctgaacgtctggccgcctgtcctcgacactgggggacttcttggcgctttggggtgcccccggggaaagaaacatgcaccctggttgggatccagggactccacaaccacccctcatcaggctcagggactgccgggaaggcactgacccctggtgggggacccaggcctcctctttggccttgccactttcttcccaggcctgcctcaacctcctcctaaaggcctggctgcctgtccccatccactgggggacttcttgatgctttggggtgccccaggaggggagacacccaccctgggtgggagccagggactccatgaaccccctggttcgggctggagggctgccagcaaggcatggacccccagcgtgggaccccagcctcttcttcagccttgccacttttttccctttcctgcctcaacttccccctgattccatataaccccgggttcaggcacggggtctgttgggaaggcacttacctctggccggggttcccggcctcttctttggcctcaccacttctttcaggactcccatgggttgggcactggggctactggaaaggccctgacccctggcgggggatcccggcctcctctttggcctctccgctttcttcctgggcctgcctcaatctccccctgaaggccgggcctcctgtccctgtccctctgggaacttcttgctgccttggggtgtccccgtatgggagagacgcaccctgggtggaagctagggactccatgaatgccccccggtcaggtgcggggactactgggaaggtactgacccctggcggggggcttcggcctcctctttggcctcgtgacttccttccccggcctgcctcaagcttcccctgaacacgtggccgcctgtccccgtctaccaggggagtttttgccagtttggggtgcccccgaaggggagagacatgcaccctggtggggaggaagcaactccatgactcccccgggttgggcgtggggactgccgggaagtcactgactgccggcaggggacctcggcctcctttttggccacattgctttcttcctgggcctgcctcaacctcccccggaaggcctggccacctgtacccatccccccagggacttcttgctgctttggcgtgcccccatggagagagacacacatacttgttggaagccatggactctacgacccccccagtttgggctgggggatgctgagaaggcactcacctctggtgggggaccctagcctcctctttggcctcgctgctttttttctaggcctgcctcaaactttcactgaaaccttggccgcctgtccccgtgccctgggggacttcttgcctctttggggtgccccaggaggagagacacacaccctgggtgggagccagggactccactacccacctgagtcaggtgtgggtgctgccaggaaggcactgacctccaatgggggacaccagcctcctcttcggcctagccacttttttctcatgcctgcctcaacctccccctggaggcctggccacctgtccttatcccccggggtacttcttgccacattacggtgcccacggaggggagacacacaccctagatgggagccagggactccacgaccccacggatcaggcatgggggctgcctagaaggcactgacttctgacgggggaccccggcctcctcttcagcatcgctgcttttttcctgggacacactcaactttcccctgaacgcctgtctgcctgtccccgtcttctgaaaatctttttgtcactttggggttcccccaggtggagagatacctaccctggttgggagccaggaactccacaacccactcgagtcaggcgcaaagtctgctggaaaggcactgaccttcgatgggggaccccggcctcctcttcggcctcactgcttttatccccggcctgcctcaacctccccctgaatgcctggccacctttccccatccccagggggagttcttgccactttggggtgcccctgggtggagagacatgcaccctggttgacagccagaaactccacgatcccccaggttttggcttggggactgctgggaaggcactgactttaggtgagaaatcctggcctcctctttggccttgctgctttcttcccaggcctgcctcaacctcccctgaaggtctggcagcctgtgcccgtccccctggggacttttgccactttgggttgtccccggggggagagacacaaatcctggttggaagccagggactccacgacccctccaggttgggcgcgggggctgctgggaaggcattgacctgtggtgggggacctcggcctcctttttggcctgctgctttcttcccaggcctgcctcaacctccctgcgaaggcctcgccacctgtcctcatccccagggggacttattgccaatttgtggtgacccaggaggggagacacacaccctgggtgggagccagggtctctacaaaccccctgggttgggtgcagtgtttctgggaaggcattgacctgccatgtgggaccccggcctcctcttcggcttccctgcatttttcccgagccttcctcaacctccccctgaaagcctggctccttgtctccttcttccagggaacttcttgccactttggtgggcccatggtgggagagatatgcaccctggttgggagccagggactccacgatcctcccacgttgagcatggggactaccgggaaggtccagacctccggcgggggaaccaggcttcctctttggcctcgacgctttcttcctgggtctgccccaacctctccctgaaggcctggctgcctgtccccatcccctgggagacttcctgccacttttgggtaccccaggaggagagacacataccctggatgggagagaaggactccaagaaccccccatgttggccgcaggggctgccaggaaggcactgactcttagcaggggacctttgcctcctcttcggccttgctgctttcatcccaagcctgcctcaacctccccgtgaaggcctggttgcctgtccccttcccctggaagacttcttgcctctttgttatgcccccggagaggagacacgcacccagggtgggagccaggaactccacgacaccaccggtttgggcacaagggctgccgggcaggcactgaactctggcaggtgaccctggccttttctttggcttcactgcttttctcccaggactgcctcaacctcccccagaaagcctggccacctgtcaacgtctgttggggtacttcttgcactttgggatgacctcgtggggagagacatgcaccctggttgggagccaggaactcaacgaatcccatggattgggcacaggggctgccaagaagacccggacctctgggggtggaacccagccccttctttggcctctccactttcttcacagacctgcctcaatctaccctgaaggcctggcctcctgtccctgtcccccgggggacttcttgctaccttggggaaggcactgaccttcagcaggggatcccagccaccattttggctttgctgctttcttcatgcacctgcttcaccctctccctgaaggtctggccacctgtcccattcccccaggggacttcttgctgctttggggtgcccctgcagggcagacaagcaccctgggtgggaaccagggactccacgactcccctggtttgggaacaggtgctgcctggaagacactgatctctggcaggggaccccggcctcctctttggccttgccacctttttcccaggcctccctcaacctccccttgaactccagacaggctgtccccatcacactagggaattcttgcctcattggagtgcccccagtgggggagacatactccctggttggaagccagagactccacgacccccttgattctggcctgggggacacagggaaagcactgatctcagtggggggaccccggcctcattttcagcctcaccactattttcccaggtgttcttcaacctcccccttaaggcctggccacctgtccccgttccctgggggacttcttgcctctttgtgatgtgtgaattcatctcacacagttaaaactttctcttgattcagcaggttggaaaaactctttgtagaatctgagaaaagacatttgaaaaatcatcgatgcctatagtgaaaaaccaaatatccccagataaatactagaaagaagctatctgtgaaacagctttctgatgtgtttactcatttcacagagttaaacctttgttttgattcaggaggttgaaaacacttcttgtagaatttgtgaagggagagttgggagctcattgcggcctacagtgaaaaacagaatgtccccagatacaaactagatagaagctatctgtgaaactgctttgtgataggtggattcattgcacagagttaaaactgtcttttgattcagcaagttggaaactctctttttgtagaaactgcaaggaaacatttgggagcctattggggcctattgggaaataccaaatatccaccaataaaaactagaaagaagctatttgtgaaaccaccttgtgtgtgtggatttatctcacagagttcaacacttctgttgacagaaaagattggaaacactctttttgtagaatctgcgaagggacatttggaagctcattgaggcctatagttaaaaaaaaaaaaaaaggaatatccccagataaatattggaaagaagctatttgagaaacgtctttgtgatgtgtagaatcatctcacaaagttaaacctttctctttattcagcaggttggaaacactatttctgtatgcactatgaagggactcttgggagcccattgaggcctataatgaaaaactgaatatccccaatgtaaactagaaataagctatctgtgaaactgctttgtgatgtgtggattcatctcagagaactaaacctttcttttgattcagcaattgaaagtactcttttttagaaactgcagagggacatttggaagcctattgaggcctatagggaaaaactgaatttccctcaataaaaactagaaagaagctatttgtggaactgctttttgatgtctggattcatctcagagagttaaacctttcttttgattcagcatattggaaacaccttctctgtagaatctgctgtgggacatttgggagcccattgaggcctacagtgaaaaaagaatatacgcagatgaaaactagaaagaagctatctgtgaaactgcattgcgacgtgtggattcatctcacagaattaaacttttcttttgattcagaaggttggaaacattctttttgtagaaactgcaaaaagacatttgggagcccactcaggccttatagtgaataactgaatattcctcaataaaagctagaaagaagctatctgtgaaactgctttgtgatgtgtggattcatctcagagagttaaacatttcttttgattctgcaggttgggaacactctttttgaagaatctgtgaaggcacatttgggagtccattgaggcctatagtgaaaaactgaatatccacagataaaaacaagaaagaacctatctgtgaaatggttttgacatgtgtggatttatctcacagtgttaaacctttccattgattaaacagattggaaacactgtttttgtaagatctgtgaagttacatttgggagctcattgatgtttatagtaagaaaatttaacatctccaaataaaaattggaaacaaactacctgtgaaacgtctttgaaaggtgtggattcatctcacatagttaaactattcttttgattcagcaggttggaaacaatcttttttagaaactgcgaagggatatttgggggcccattaaggcctatagtgaatatcccctgataaaaattagaaagaagctatctgtgaaactgctttgtgatgtgtggattcatctaagacagtaaacctttcttttgattcagcagtttggaaacactctttttgtagaatcagcaaagggacattttggagctcattgaggcctatagtgaaaaactgaatatgcccagatagaaaccagatagtagctatctctggaactgctttgcaaaggatggatttatctcccagagttaaatttttcttttgattcagaagttggaaacactgtttttgtagaaactgcaaaggaacatttgggagcccattgaggtctagagtgaaaaactgaatatgtgcagataaaaactagaaagaagctacctttgaaaccaatttgtgatgcatggattcatctcacagagttaaaccttcttttgattcaacaggttggaaacactctttttgtagaatctgcaaagtgacatttgggagctctttgaggcctacagtgaaaaaccgaataatcccagatagaaagcagatagtagctatctctgaaactgctttgcaaagggtagatacatctaccagagttaaatctttctttttattcaggagttagaatcactctttttgtagaaactgtaaagggacatttgggagcccattgaggcctagattgaaaaactgaatatcctcgaataaaaactagaaagaagctacctttgaaagcaatttttgatgtacggattcatatcacagagataacctttctttcttttgtttcaggagtttgggaacattctttttgcagaaattacgaagggacatttgggagcccaatgaggcctagagtgaaaaactgaatatctacaaataaaaactacaaagaatgtatttgtgtaaccactttgcaatgtgtggattaatctcacagacctaaaattttcttttgattcaacaggtgaaaaactctctttttgtagaaaccgcgaagggacatttaagagcctattgaagcctatagtgaaaaactgaatatctgtggataaaaactggaaaaatgctatctgtgaatgcactttgtgatgtgtggattcatctgacagatttaaacttgtcttttgatttagcaggttggaaacactcttttagcagaatctgtgaatcgacacttggaatctgatagaggcctgtagtgaataactgaatatcccatgacaaaaattagaaagaagctatttgtgaaactgctttgtgatgtgtggattcatctcagagagttaaacctttcttttgattaaacaggttggaaagaaacactctttttgtagaatctgcaaagtgacatttgggagctcattgaggccaatagtgaaaaattgaataatctcagatacaaacctgaaaccaccttagaaaaagtggattcatctcctagatttaaatctttctttcgattcagaagttggaagcactctttttgtagaaaagtgcaaagggacttttgggagtccatggaggactatagtgaataactgattatccccagtaaaaaacaagtaagaagctatctgtgaagccaatttgcaatgtgtggattcacctcacagggtgaaaactttgttttgattcagcaggttggaaacactgtttttgtagaatccatgaaggaatatttgggagcccattgtggtctagagtgaaaaaccaaatatctgcaaataaaaaatagaaaaatcctgtctgtgaaactgctttgtgatgtgtggtttcatctcacagagttaaacctttctttgattcagtgggttttaaacagtttttttgtagaatctgcaaaggtatatttggaagcccattgaggcttatactgacaagctgaaaaaacccatgtaaaaactagaaagaaagtatctgtgaaactgctttgtgatgtgtggattcatctcacagagttaaacatttcttttgattcagcaggatgtaaacactatttgtagaaactatgaagggacatttgggagcccactgaggcttatagtgaaaaaccaaatatttgccaataaaaactagaaagaagctgtgtgacactgctttggtatgtgtgtagtcatctcacagacctaaaactttcttttgattccactggttaaaaccactctttttgtagaaactgcaaagagacatttaggagccctttgatttctataataaaaaacagaatattctctgataaaaacagaaagaagctattgtgaaactgctttgtgatctgtgtattaatctcagagtgtaaaaactttcttttgatttctcagtttggaaacacttttttttgtggaaactgcaaaaagacatttgggagatcattgaggcctgtagtgaaaaactgaatatccccagaaaatactagaaagaaactgtctttgaaactgctttgtgatatgtgtatttatctcagaaagttaaacctttcttttgattcctcaggttggaaacatcatttttgtagaatctgcaaagggatgtttgggagtccaatgagacctatagtgaaaaactaaatatccacagataaaaactagaaagaagctatcagtgaaagggctttgctatgtgtggattcatcttacagatttaagcctttcttttgattcaataggttggaaacactgtttttgtagaaactgtaaagggacatttgggaccccattgtggcttattgtgaaaacccatataccttccaataaaacctcaaaagaagctatctgtgaaactgctctgtgatatgtgtattcatctcatagagttaaatcttattttgattcagcaggttggaataactctttttttgtggaatctgcaaagggatatttgggggctcattgaggcctacagtgaaaaacaaaatatccaaggataaaaagtagaaagaaggtatctgtgaaaccgctttgtgatgtgtccatgcatcacacagacttaaaacttctctttgatttcacaagttggagacaccctctttgtagaatctgtgaaaggacagttggaagcccactgaggcctgtagtgaaaagctgaatgttcctagataaaaactataaagaagctatctgtgaaacatttttgtgatatgtggattcacctcccagacttaaatctttcttttgattcagcaggttggaaactctctatttgtagaaactgcgactagacatttggaaccccattgattcctatagtgaaaaacagaataatcatgaataaaaactagaaagaagcattctgttaaaccagtttatgatgtgtgtattcacctcacagagttacacttttctactcattcagcaggttgaaacactctttttgtagaatatgtgaagggacattggaagcccaatcatgcctatactaaaatactgaatattcctacataaaaactagaaataatctatctgtgaaaccgctttatgatgtgtggtgtcatctcacagagataaacctttttttttgactaagcaggttggaaacactctttttgtaaaacctgtgaggggttttacaaaccctttgggagaccactgaggcctaaagtaaaaaactgaatatccacaggtaaaaactagaatgaaactttcagtgaaaccactttgtgatgtgtggaatcatctcacaaaagtatattttttttaatgctccagattaaagactgtctttttgtagaatttgtaaagggacagttcagagcccattgaggcctatgggaaaaaagcagaatattcccagatcaaaactagaaagaagctatctgtgaaacttctttgtgatgcttggattcatctcacagagtttaacctttcttttgattcaacaccttagaaacgcttttttttgtagaatctatgaagggacatttgtagaatctatgaagggacatttgaaagttcccatagagaaaaatgggatatttccagataaaagctagaatgaagctatctgtgaaaccactttgtgatgtgtggatacatttcccagaggtaaatcattcttttgatacagcaagttggaaacatactttttttagaaactgcaaaagaaaatcctggcacccattgaggtccaccgtgaaaagactgagtatccccctcaaaaaaaaatagaaagaaggagtctgtgaaattgctttgtgatgtgtggatttatctcactgagttaaacctttcttttgatttcacaagttgaaaatacgttcgtgtagaatctacgaaaggacatttggaagtccactgaggcctgtactgaaaaactgaatattcccacacaaaaaaataaaaactggaaggaagctatctatgaaaccactttgcactgcatggaatcatctcacagacttaaagatttcttttgattcagcaggttggaaacactctttttgtagactctgtgaagtggcatttgagagcccattgaggcctatagtgaaaactgaatatccccagattaaacctagaaagaatctatctgtgaaatggcttttggatatgtgaattcatctcacagagttacatctttcttctgatttagaaggtaggaaacactctttttcaggaatctgtgaagggacatttgggagaccattgatgcttatagtgaaaaaccaaatatccccaaattaatactagaaagaatttatctgtgaaatggctttttgatgtgtagaatcttttgatttagaaggttggaaacactctttttaaggaatctgtgaagggatatttaggagcccttttaggcctatggttgagaaactaaatatcaacagataaaaaatagaaagactctatctgtgaaactgctttgtgaaatgtcaatttatctcacagagttaaatgtttcttttgattcagcacgttaaaaacactctttttgtaaaatctgtgaaggcaaatttggaagcccattgtggcctatgatgaaaaatcaaatatcctcagataaaaactagaaagaaactattggtgaaactgctttgtgatgggtggattcatctcacaaagttaaacctttctttcgattcagcaggttggaaccccttcttttgtagagactgtgaagggacactttgtagcccattgaggcctacagtgaaaaaccaaatatcccttgataaaaactagaaagaagctacctgtgaaatggatttatgatgtgtacaataatctcagagagttaaacctttattttgattcagcaggttggaatcactctttttttagatcctgagaagggacatttggcagctcattgaggcctgtagtgaaaaacagaatatccccagatgaaaagtagaaagaaactatctgtcaaccactttgtgatgtgtggattcatcttacagagacaagcctttgttatgtctcagcagattggaaacactctttttgtagaatctgtgaagagaccgtttgggagaccattgaggctaatagtgaaaaactgaatatccccagataaaaactggaaagatgctatttgtggagccacttcacaatgtgtggattcatctcacagagttcaacctttcttttgatttagcagcttagaaacactctctttgtagaatgcttgggacatttgggagctcattgatgcctatagtgaaaaactgaacaacctaagataaaaagtagaaagaagccatttgtcaaaccacttttcaatttgtggattcttttcacagggataaaactttcttttgatttagcaggttgtaaacactgtttttgcagaatctgtgaatggacattttggagcccattaaggcctgtagtgaaaaaccaaattttttacttaaaacctagataatagatatctgtgaatccactttgtgatgtgtggattcatctcacagagttaaaccattctttttattcagaaaattggacacactctttttgtagaatattcacagggacatttggaagcctattgaggtttaattgaaaaccaaaatatcccaatataaaaactagaaagaatctatgtatgaaacctctttgtgatgtgtcgattcatcttacagagttaaacctctcttttgattcaacagattggagacactctttttgtagaatctgcgaagggacatttgggagcccatttgggtctatagtgaaaaactgaacatccccagataaaaactagaaagaacctctctgtgaaaccttttgcaatgggtgcattcatctcacagaaataaagctttcccttgatgcagcaggttggaagcacactatttaaagaaattttgaagggacatttcaaagcccagtgtggcctataatgaaaactctagtgtccatgaataaaaaatggaaagaaacaatctgtgaaacaactttgtgataggtggattaatctcacagagttaaacctttcttgtgattcagcaggttggaaacattctttttgtagactctgtgaagggacattaaaagtccattgatgcctatactaaaaaactgaatattcctacataaaaacgagaaaaacctatctatctgtgaaagcactttgtgatgtgtcaattcatctcagagagttaaacctttcttttgattcaacagttttccatacttttttttgtggaaactgggaagagatattgaggagaccattgagttatatagtgataaaccaaatatccactgataaaaactagaaagaagctgtatgtgaaattgttcagtgatatgtggattcatatcagagagttaaactttcttttgattcagcagactggaaactctgtatttgtaaaaattgcaaagggacatgtgggagccaattggggcctagagagaaaaacagaatattcatggataaaaactagaagaaagctagctgtaaaatggctttctgatgtgtggattcatctcacagaaattaaactttttttttgattcagcaggttggaaacactctttttgaagaaactgcaaatggacattttggagccccttgagctctataataaaaaagtgaatatccccagataaaaactagaaagaagctatttgtgaaactgcttcatgatgtgtttattcatctcagagatttaaactttcttttgattcagcaggttgcaaacactcttttttgtggaatctgtgaagggacattttggagtccattgatgtcaagagtgaaaaactgaatatccatggatgaaaacaagagagacgctgtctgtgaagccattttgcaatgtgtggattcatctcacagagtgaaacctttcttttgattcagcacgtggaatcactctttttgtagaaacttgaaggagtatttgagagtccattgaggcctatggtgaaaaaccgtatatccctcaataaaaacgggaaagaagtgatctgtgaaactgctttgcaatgtgtggattcatctcacagggttaaacctttcttttgattcagcaaattggaaacactcctcttttagaatttgtgaagggacatttgagagcccattgaggcctatagtgaaaaaccaaatattccccaataaaaactaggaagaagctacctgtgaaaccactttgcaatgtgtggattcatctcacagagtaaaaactttcttttgattcaacaagtttgaaaccctctttttgaagaagctattaagggatatttggaaccctggaggcctatactgaggaactgaatatcaccatatagaagctaaaaagaagctatctgtggaaacgctttcctaagtgtggattcatctcacagagttaaatttctcttttggttcagcaggtgggaaacactgtttttgtagaaactgcgaagggacatttgggagcccattaagcctgtagtgaaaaactgaatagcccttgataaaaactagaaagaagctatctgtgaaactgctttttgatgtgtggattcatctcacagagttaaactttttttttgattcagcaggttgaaaagactctttttatagaaactgcaaaggcacaattgggatctcattgaggtctacagtgaagaacaaaatatctgcagataaaaactagaaaaaaactgtctgtataactgctttgtgatgtgtggattcatctcacagaattctttcttttgattcagaaggttggaaacaggctttagtagaatctatgaagggacatttggcagctcattgaggtgtatagtgaaaaattgaatatcccaaaatgaaaactcaaaagaagctatttttgaaacgtctttttgatgtaagaattcatctcacagagtaaaacctttgttttgatttagcaggatgggaacactattttgtagaatctgtgaagggacatttgggagaccattgaggcctatactgaaaaactgaatatccacatgtaaaaactacaaagaagctatctgtgaagccgctttgtgatgtgtggatttaactcacagagttaaaccttgcttttgactcagcaggttggaaactttctttttgtagaaactatgaagggacatttcaggcccattgaggcctatagagaaaaatcaaatatttcctgatacaaactggaagcaatctatctatgaaattgctttgtcatgtgtggatttgtctcacagcattaaaccttttattttgattcagcaggttggaagcactctttttgtacaatctgcaaagggaattttggagctcactgagggttttagtgaaaaacagcatatcagtgaataaaaaccagaaagaatctatctctgaaactgttttgcaaagtgtggattcatctcacatagttaaatcattcttttgatacagcaggttggaaacactctttttggagaatctgcgaaggaacatttgggagcccctttaggtccataataaaatacctaatatcccccaataaaaactggaaaaaagccatctgtgaatctgctctgtgacttgtgcaatcatctctgagagttaaacctttcctttgattcagcatgttgaaaacactattttgtaaatcctgtgaaggggcatttgggagcaaattgagtcctatagtgaaaaaagacatatccttggataaaaactagaagaacctatctgagaaaccgccttgtgaagtgtggattcattgcacagggttaaacctttcttttgattcagaaggaagaaactgtgaaggggcattttggagaacattcagacttatactgaaaaactaattattcacagataaaaaccagaaacaagctgtctgtgaaactactttctgatgtatggatgcttctcagagacttaaacctttcttttaattcagcaagatggaaacattctttttatagaatctgataagagacatttgggagcccattgaggcctagaatgaataactgaatatctgcagaaaaaaatagaaggaagctaacagtgaaaccactttgtgatgtgtggattcatctcatggagttaaaactttcttttgattcagcaggttggaaacactccttttgtagaaactgcaaagggacttttgggagcccactgaggcctatagtgacaaactgattatcccccagtaaatactggaaagaagctatctgtgaaactactttgtgatgtgttgatttatttcagagaggtaaacctttcttttgaatcctcaggttggaaatgcccttttttgtagaatctgggaatggacattttttacccattaagcctgtaatgaaaaatcaaatatccacagataaaagctaggataaatctatcagtgaaattgctttgcaatgtgtggattcttcccacagagttaaaactttcttttgattcaataaggtaggaaacactctttttgttgaagctgctaaggaacaaatagaagcccattgagggctttacaggaaaacagaatattaccatataaaaactagaaagaagctatctgtgaaaccactttgtgacatgtggattaatctcacagagttaaacctttctattgattcagcaggatgaaaatactctttttgtagaatttgcaaagggaaatctgggagcccattgaggcctatagtgaaaaagaaaatatccacaaaaaaaaaactagaaagaagctatctgtaaaaccactttgcaatatgtggactcatctcccagagttaagtctttcttttgactcagcagttcagaaacactttttttgtagaaaccatgaaaggacatttggaagcccattgaggcatagagagaaaaactgaatatctgtgaatgaaaactagaaagaagctacctgtgaaaccactttgtgatacgtggactcatctccgagaattaagtctttattttgattcagcagttcagaaacttttttttttttgtagaaaccatgaaggaacatttgggagcccattgaagcatagagagaaaaatcaaatatctgcacataaaatctaaaaagaagccatctgtgaaaccatattatgatgtgtggatatttctacagagttaaacctttcttttgattcagcaagttgggaacactttcctatagaatttgtgaagggacatttgtgagccccttgaggcctaaagtgaaaaactgaatatccgcagataaaaactagaaagaagacacctgtaaaattgctttgtgatgtgtgggtttatctctcagagttcaacctttcttttgattcaggaggttggaaacactctttttgtagaatctgtggagggatatttgggagctttttgatgcttatggttgaaaaacccaatatcaacagacaaagtctcgaatgaagctatatgtgaaactgctttgtgatgcctatattcatctaacagagttaagccttgtttcagcagattcagaacattctttttgtagaatcagtgaagagacatttgggagcatattgaggtctattgtgaaaaactgaatatccccagataaacactggaaagaactatctgtgaaactcctttgtgatccatctcacagagttaaacctttcttttaattcatcaggttggaaacacttctcttttgtagaatatgtgaggggacatttggaagcccactgaggcctacggtgaaaaactgaatatttccagggaaaaactagacagaatctacgtgtgaaactgctttgtgatgtgtggattcatcttacagagttaatttttacttgtgattcagaaggttggaaacactcttcttgtagaatctgcaaagggacatttcagagcctattggggccaatggtgaaaaatcaaatattccagataaaaatgagaaggtagctatctgtgaaactgttttgggttgtgtggattgatgtcatagagttaaacctttctttttattcagcaaatgggaaagactctttttgtagaatttgcaaagggacatttgggagcccattgaggcctacattgaaaaatggatatcactagataaaaactggaaagaagctatcaaagagtctgctttgtgatgtgtggattcatgtcacagagttaaatgtttctttagattctgcgggttggaatcattctttttgtagaatttgcgaagggtcatttggtagtccattggggcctatggtgaaaaactgagtatctccagataaaaactggaaaaaagccatctgtgaaactgctttgtgatgtgtcaattcatctcacagagtaaaattttcttgtaattcgtcatgttggtaacgctgtttttgtagaatctgtgatgggacgtttgggagacaatttaaacctacagtgaaaaacagaatatccccagattaaaaataaaaagaagctatctgtgaaactgctttgtgatgtgtgcattcagcaggttggaaactctccttttgcagaatctgcaaagggacatttgggagcccattgaggcctttggtgaaaaactgaatatccatacataaaaactaggaagaagttttgcgtgaaactgctttgtgttgtttggattcatctcgcagaattaaacgtgtcttttgattcagcaggttggaaaccctattttgtagaatctgcaaagggacattagatgggagcccattgaagcctagggtgaaaaactgaatctccccagataaaaactagaaagaagctatctgtgaaagtgctttgtgatgtgtggattcatctcacagaggtaaacctttcttttggttcagccagttggagactcttgttttgtggaagctgcaaagaaacattttggagcccattgaggactatggtgaaaaaaacgaatatccacagataaaaagtagaaagaagctatctgtgaaacttgtttataatgtgtggattcctctcacagaattaactttttttttttattcaataggttggagacactcatttggtagaatctgtgaagggacaatagggagcccattgaggcctacagtgaaaaaccaaatatcactagatgaaaatgagaaagaagctatctgtgaaacagctttgtgatgtttggattcatatcacagagttaaacgtttcttttgatttagcatgataggaaacattctttttgcagaatctgtgaagtgatatttggaaacatgttcaggcctatggtgaaataccaaatattccctgataaaaactagaaagaagttatctgttaaactgctttgtgatgtgtggattcaccaaacaacaaaaaaaactttcttttgagtcagcaggttgaaaacactctttctgtagaatctgtgaagggacgtttgggaccccattgaggcctataatgaaaacaaaaatatccccaaataaaaactagaaagaggctacctgaaaaactgctttggtttaaatggattcatctcacaaaattaaatctttctttagatttagcagttggaaacactctttttgtagactcagcaaaaagacatttgggggccctttgagggctatacttaaaaaaccaaatatcaaaagataaaaactagaatgaagccatctgtgaagttgtttgtgatgtgtggattcatctcacagagttaaacctttcttttatttcaggagattggaaatggtctttttgtagaatctgcaaagagacatgtgggagcctattggggcctatcatgaaaaatggaatatctttagataaaaactagaaacaagctatctgtgaaactgctttgtgaagtgtgtatttatctcacagagttaaatttttttttattcagcacgttgcaaaccctctttttgcagaatctgtgcaggtacatttgtaagcccattgaggcctatggtgaaaaacaaaatatttcctgaaaaaaaaaaaaactaggaaaaggctatctgtgaaactgccttgtgatgtgtggattcaccacacagagataaacctttcctgaaacattctatttgtagtatctgctaagggacatttgggagactacagtaaaaagctgaatatccccagagaaaaactaggaagaagctgtctgtgaaactactttgtgatgtgtggattcatcatacaagttaaaactttctttgattcatcatgttggtaacactcatcttgtagaatcagtgaagggacatttgggagctcgttaagggctaaggtgaaaaacagaatatccccagataaaaacaagaaagaagctatttgtgaaacagctttgtgttgtgtagattcaagtcacagaattaaatctttcttttgattcaaaaggttggaaacactctttttccagaatctgcaaaggggtatttgggatcccattgatgcctatggtgaaaaaccgagtacctttagataaaaactcgaacaaaacctatctgtaaaactgctttatgatgtgtggattcagctcactgagttaaaccatttttttgattcagcaaattggaacctatctttctgtagaacctacaaagggacatttttgagcctattgaggcctaaggtgaaaaactgaatatccccagattaaaactagaaataagctatctgtgaaactgctttgtgatgtgtggattcaccttacagagttaaacctttcttttgattcatcaggttggtaacactctccttgtagaatttgcaaagggacattttggagctcatttaggcctaaggtgaaaaatcgaatatttccaaataaaaactagaaaaaagctatctgtgaaactgctttgtgctgtgtgcattcatctgacagagttaaagctttcttttgattcggcaggttggaaaaagtctttttgtagattctgtgaagggactttggggtcccattgaagcctacattgagaaacagataatccccagatacaaagtaaaaagaagctatctgtgaaatttctttgtgatgtatggatttatctcacagagttaaaacaatcttttgattcagcaggttggaaacactttttttgtagagcctgcaaaaaaacatttgagagcccattgaggcctttggtgaaaaactgaatatccccagataaaaactagaaaaaagttatttgtgaaactgctttttgatgtgtggattcatctcacagatttaaaccattttttatttagtaagttgaaaacactctttttgtagaatctgtgaaaagacatttgagagtccattgaggcctacagtgaaaaaccgaatatccttagagaaaaactagaaagaacctattttgaaactgctttatgttgtgtggattcatctcccagagttaaatttttcttttcattcagcaggttggacatactctttttgtataatctatgaagagacatttgggagctcattgaggcctatggtgaagaaccgaatttccccaattaaaaactagaaagattctatttgtgaaaatgctttgtgatgtgttgattcatctcacagagttaaatctttctttttactcagcaggttgtaaacactctttttgcagtatctgtgaagggacacttgaaagcccattgaggcctctggtgcaaaaccaatttctttggataaaaactagatagaatttatcagtgaatgtgctttgttatgtgtggattcctctcacagagttaaaccttttttttttttttagttcagaacattgaaaacattctttttgtagaacttgtgaagggacatttgggagcccattttggcctatggggaaaaatggaatatccccagataaaaactagaaagaagttatttgtgaaactgctttgtgatgtgtggatttatatcacagagttaaaccttttttttcattcagcaggttgaaaacacttttttttttttttttagaatctgcaaaaggatatttgggagccctatgtggtttatggttaaaaaaactaatataaacagatgaaaactagaatggaactacctatgaaactgctttgtgatatgtggattcatctcacaaagttaaaacttttttttcagaaggttggaaacactgtttttgtagcatctgtgagggacatttgggagcccattgagggctattgtgaaaaacctaatttccctagataaagactagaaacaagctatgtgtgaaactggtgtgtgatgtgtggattcatctcacacagttaaaactttcttttgaatcagcactttggaaacactctgcaagtagaatttgtgaagagacatttgggagcccattgaggcctatggtgaaaaaccgaatatttccagataaaaactagaaagacactacttgtgaaactgctctgtgaggtgtgagattcatctcacaaagttgaaactttttttggattaaacacatcggaaacactctttttgtagaatctgtgaaggaacatttgggagccaattggggcctgcggtgaaaagccgaatattcccagaaaaaaactggaaagacgctatctgtgaaactgctttgtgatgtgtggattcatctcacacagttaaacttttcttttgattcagcctgttgggaaaactctttttgtacaagtggcaatgggacatttgggaatgttttgaggcctgtggtaaaaaactgaatatccccaggtaaaaactagaaagaaactctctgtgaacttgctttctgatgtgtggattcattacagagttaaacatttcttttgattcagaaggttggaaacactgtttttgtatactctgcgatgggacattttggagctcattaaggcctatgatgaaaaaccaaatatctcaagataaaaactagaaaaaagttatctgtgaaactgctttgtaatgtgtggattcatctaacagagttaaacctttcttttcattcagcagcttgaacgcactctttttgtagaatctgcaaagggacatttgggagcccattgaggcttatggtgaaaaactgaatatccccaggtaataactagaaaaaacttatctgtgaaactgctttgtgtggtgtggattcatctcccatagataaatctttcttttgattcagcacattggaaacactttttttgtacactctctgatgggacatttgggagctcattgaggcctatggtgaaaaactgaatctccccaggtaaaaacgagaaagaagctatttgtgaaactgctttgtgaagtgcggattgatctcacggagatcaacttttcctttcattcagcatgttggaaacactttttttgtagaatctgtgaagggacattgggacctctttgaggccaatggtgaaaaactgaatatctccaattaaaacctagacagaatctttctgtgaaactgtgttgtgatgtgtcaattcatgccacagagttaaacctttctttttattcagcaggttgtaaacactctttttgtagaatctgcaaagggacatttaggagcccattgatgcctatgttgaaaaattgaatatccccatgtaaaaactagaaataagctatcagtgaaactggtttgtgatttgtggatttatctcacagatttaaacgtttgtttttattccacaggttggaaacactctttttgtagaatttgcgatgaaacacttgagagccttttgaggcctatggtgaaaaacagaagagcccaagataaaaaactagaagaaatgtatatgtgaaactgctctgtgatacgtggattcaccacacggagtgaaacctttcttttgatgcagtaggtttaacacactctgtttgtacaatgtgcatagggacatttagaagcccattgaagcctatgctgaaaaaccaaatattcccagataaaaactagaaagaagttatctgtgaaactgatttgtgatgtgtaaatacaatgcaaagaattaaacctttcttttaattcagcatgttggaaacgctctttttgtagtatctgtgatgggatatttgagagcccattggggcctatattgaaaaatcgtatataaacctttcttttgattcagcaggttggaaacactctttttgtaggatctgtgaggggacatttgggaacccttggaggtatatggtgaaaaaatgaatgtccccagatagaaacgaaaatgaaactaactgtgaaaatgcctgtgacctgtggattcatctcacagagttgaaactttcttttgattcaacaggttgaaaacactgtatttgtagaatctgcaaagggacatttgggagcccattgatgcctatggtgaaaaactgatactcccagataaaaactgggaagaatgtatctgtgaaactgctttgtgatgtgtggattcaccttacaaagttaaaactttcttttgattcataaggttggtaacactctccttgtagactctgtgaatggacatttgagagcttattgagaactaaggtgaaaaactgaaaatccccagataaaaactagaaagaagctacctgtgaaagtgctttgtgatgggtggaatcatctcgcagagttaaacctctcttttgatacagcagagttggaaacactccttctgtaggatctgcaaagggaaatttcagatcccactgagaactatggtgaaaaaatgaacatctccactaaaaaaccggaaagaagctatgtgtgaaatggctttgtgatgtgccaatttatctcacagagttaaacctttctttaaatgcagcaggttggaaacactttttttgtagaatctgtgaagggacaattgtgagtccattggggcctatggagaaaaactgaatatccccagatgaaaactagaaagaagctatctgtgaaactgctttgtgatgtgtgaaatcacttcacagaattaaacctttcttttcattcaacagattggaaacactctttttgtagaatctgcaaagggatatttgagagcctatagtggcctaaaataaaaaattgattatctaaagttaaaaactagaaagaaactatctgtgaaactgctttgtgatgtgtgaattcatcttacagatttaaaactttgttatgattcagaaggttggaaacactcttattgtagaatctgctaaggggcatttggaagaccactgaagcctaggatgtaaaacagaatatccccagataaaaactagaaagaagatatgtgtgaaactgctttgtgatgtgtggattcacctcacagagttaaaagtttcttttaattcagcaggttggaaacactatttttgtagaatctgcgaagggacatttgcgagtccattgaggcctatggtgaaaaaccaaatatccccagataaatactagaaagaagctatctgtgatgggtggattcatctcacagtgttaaacctttcttttgattcagcaggttggaaacgctctttttgtagaatctgccaaggaacgtctgggggcccattgaagcctatgatgaaaaaccacatatctctaggtaaaaactagaaagaaactatctgggaaactgctttgtgatgtgtggattcatctcacagcgttaaatctgtcttttggttcagcaggatgaatacattcttttgtagcctcttcaaaaacacattttggagcacattgaggcccttggtgaaaactgaacatcacttggtaaaaactagaaagaagatatctgggaaactgctttgtgatgtgtggattcatctaagagatttaaacctttctttttatccagcagtgttttatcaacactctttttgttgaatctgcaaagagacatatgggaacccattgaggcataggataagaaacagaatatccccagataaaaatggaaagaagctatatgtgaagctgctctgtgatgtgtgaactcatcttacatagttaaaactttctgttgactcatctagctggaaactctctttttgtagaatctgcaaagaaacatttgggagcccattgaggtgtaagataagaaacagaatattcccacataaaaactagaaagaagctatatgtgaagcttctctatgatgcgttaattcatcttacagagttaaaactttcttttgattcatctagctggaaactctctttgtgtaggttctgcaaagacacgcttgggagcccattaagtcttatgttgaaaaacagaatatccccaaataaaaactagaaaaaagtttgatgtgaaactgctttgtgatgtgttgattcatctcacagagataaatctttcttttgattcaacaggttgcaaacactctttttgtaatatctgtgaagacacatttgggagcccattgagccctatagtgaaaaactgagcatccctagataaaaactataaagaagctgtctgttcaaccagtttgtgatatatggattcatctcacagatttaaacatttgttttgattcagcaagttgaaatccctctttttgtagaatctgcaaaggggaaactggaggccattgaggattctgctgaaaaacagaataccccagtttaaaaatagaaattatcaacctgtgaaacgtctttgtgatgtgtggattcatttcataaattaaacctttcttttgattcagaaggttggaaacactctttctgtagaaactgcaaattgacatttgggagcccattggggcctgtagtgaaaaactgaatatccccagataacagctagaaagaagctatctattgctttgtgatttgtggattcatctcacagagttaaaccagtctttatattcagtaagtaggaacactgtttttgtagaatctgtgaagggacattggggatcccattgaggtctataataaaaaacccaatatccccagataaaaactagaaagaaattatctgtgaaactgcttggtgatgtgtggattcatctcacagtgatgcacctttattttgattcaacaggttggaaacactctttttgtagtaactgtgaagggacatttgggagcttattttcttatgctgaaaaactgaatattctcagataaaaactgcagagaagcaatctgtgaaactggtttgtgatgtgtggattcatctcatatagtcaaatcttacttttgatcaccaggctggaaacacatttttttttgtagaatctatgaagggacatttgagatcttattgaggcctttggggaaaaactgaataatcccagacaaaatctagaaagaagctctctgtgaaactgcttcatgatgtgtggagtcatctcacagagttaaacctttcttttgattcaataagttggaaacactctttttgtggaatttgtgaagagacatttgggagcccattgaaccctactgggaaaaaccaaatatccccagataaaaactagaaagacattatctgtgaaactgctttttatgtttggattcatctcacacagttaataattttttttttgattcagcattttggaaacacttgtttgcagaacctgcaaagggacatttgggagcacattgaggcctgtggtgaaaaactgaatatctttagataaaaaagaagctagttttgaaactgctttgttaggtgtggattaatctcacaaagttaaatctttcttttgatttaacaagttggaaaaactctttttgtagaatcagtgaagggacatttgagagccatttgaggcctatggtgaaaaaccgaatatccccagagaaaaactagaaagaagatatctgtgaaactgctttgtggtattctcacagtgttttccctttcttttgattcagcaggttggaaacgttctttttgtagaatctgcaaagggacattgggaagcccattgaggtctacagtgaaaaattgagtatcttcagataaaaactagaaagaagctacttgtgaaacttatttgtgatgtgtggattcttctcccagtgttaaacttttcttttgattcaagaggttgaagacactttttacagaatctgcaaatggacatttaagaacccattgaggccaatgttgaaaaacataatatccccagataacaactggaaaaaagctattcgtgaaactcctttgtgatcggtggattcatctcacagagttaaacctttcttttgattcagcaggttggaaacactcttttgcagaattggcaaaaagacaattgggagcgcattgaggcctatggcaaaaaaccaaatatcctcagattaaaactacaaagaccttatctgtgaaactcctttgtgatacgtggattcttctcccagagttcaacctttctgtggattcagcaggttggaaacactctttttgtagaatctgcaaagggatatttggagcttattgaggcctatggtgaaaaactgaataaccccaaataaaatctagaaagtagctctctgtgaaactgctttgtgctgagtggattcgtcttacagaattaaacctttcttttgattcagcaagttggaaacactctttttgtggaatctgcaaaaagacatttgggaacccattgtatgctgtggtgaaaaatcgaatatccccatataaaagctaaaaagaaggtatcagttaaactgctttttgatgtttggattcatctcactcagtcaaatctttcttttgattcagcaaattggaaacactctttgtagaacctgaaaagggacatttgggagcccatggaggcctttggtgaaaaaccaaaaatccctagataaaaactagaaagaagctatctttgaaactgctttgctatgtgtggattcatctcacaaagctaaacctttcttttgattcaacaagtcagaaaaactctttttgtagaatcagtgaagggatattttagagccctttgagttctattgaaaaacagaatatgcccagagaaaaactaaaaagaagctatctgtgaaactgctttgtgatatgtggattcatctcatagagtttaacatctcttttgattcagcaggttggaaatacatttttgcagaaaatgtgaagggagatttggatcccattgagggctatgtggaaaagccaaatatcctcagttaaaagcttgaaattagcaatctgtggaaagtctttgtgatgtgtggtttcatctcagaaagttaaaactttctttagattcagcagattggaaacgtgctttctgtactatctgtgaagggaggcttgggagcacattgtagcttatagtgaaaaatcaagtaatccctgatacaaaccagaaagcagctatctgtgaaactgctttgtgatgtgtagattcatcacaaaaagtgaaatatttctattgattctgcaggttgaaaacacactttctggagaatctttgaagggacatttcaaagacctctgagatctgtggtgcaaaactgaatatccccagataaaaaccagaaggaagctatctgtgaaactgatttgtgatgtgtggattcatctgacaaagttaaaccttaatttagattcagtaggttggagacactatttttgtagaaactgcgaagggacactttggagcccattgaggcctatggtgaaaaaccaaatatccctagataaaaactggaaagaagctatctgtgaaactgctttgtgatgtgtggatttatctcacagagttaaacctttgttttgattcatcaagttgacaacactctttttgtagactctgcagaggaacattcgggatcccattgaagcctgtggtgaaaaaccaaatatccccagagaaaaaaaaatagaaagaaactatctgtgaaagtgctttgtggtgtgtatattcatctcagagagttaaaacattcttttgattaagcaagttggataaacactttttgtagaatcttcaagggacattttagagtccattgaggcctatggtaaaaatccgaatatctccatatgaaaaccaaaaagaagctatatgtgatactgctttgtgatgtgtgaattcatctcacagagttaaaactttcttttgattcaacaggttggaaacactctttttctggaatctgcaaaggagaatttggcagcccattgatgcctacagtgaaaaaccaaatctcccaagacaaaaactagaaagaagatatctgggaactggtttgtgatgtgtggatctatctgacagagttaaaggtttcttttgattcagcatgtgggaaacctcttttgtagaatctgcaaagggaaatttgtgagcccattgaggcctatcatgaaaacccaaatattcccagataaaaatgcaaaagaagctatgtgtgagtctgccttatgatgtgtggattcctctcacagagttaaatctttttttgattcagcaggttggaaaaactatttctgtagaatctgtggagaaacatttgggaatccattccggcctatggtggaaaatgcaataacctctcataaacactagaaagaagctatctgtgaaactgctttgtgatgcttagattcatctcacaaaggtaaaactttcttttgattcagcatttctgaaacactctttttttatcatctgcaaagggacatttgggagaccattgaggcctatggtgaaaaacagaatatcccctgataaaaactagaaagaatctagccgtgaaactgctttgtgacgttatcaacttatcttgcagagttaaatgttccttttgattcagcacgttaaaaatactctttttgtaaaatctgtgaaggcacatttggaagcccattgaggcctatgttgaaaaacagaatatcctttgatacagactagaaagaagctatctgtgaaattgctttgtgatttgtggattcaccacacagagttaaacctttcctttgattccacaaataggaaatactcttttgtagaatctgtgaaggaatatttaagagcctttggaggactatggtaaaaaactgaacatcactgcataaaatcttaaaaaatgttaacagtgaaaatgctttgtgatgtgtggattcatctcacaaagttaaaattttcttttgattcaacaggttggaaatgctctatttgtagaatctgtgaagagatatttgggatcccattgagacctatggtgaaaaattgaatatccccagaaaaaaaaattagaaaaaagcaatctgtacaagtgctttgtgctgtgtatattcaactcagagagttaaaactttcttttgattaagcaggttggaaaaactctttttgtaaaatctgtgagggatatttgggagtaaatttagtcctaaggtaaaaatcctaatatccccataaaaaaactttttttgtgatactgctttgtgatgtgtggatttatctcagagttaaaactttcttttgattcaacaggttcgaaacactctttttctagaatcttcaaaggaacatttgaaagcacattgatgcctatggtgaaaaactgaatatacccagagaaaaactagaaagaagctctctgggaactgctttgtgatgtgtggattcatctcacagagttaaatgtttcttttgattcagcattttggaaacagttttttgtagaatttgcaaagggacatttgggagcccattgagaccaatggtgaaaaagcaaatatccccagaaaaaaaagtagaaagaatttatctatgaaactgctttgtgatgtattgattcatctggcagaattaaacctttcttttgattcagcaggttgtaaacattccttttgtagaatctgcaaaggaacatttgggagtctattgtggcttatggcaaaaaactgaatattccaagataaaaatgcaaaagaagctatgtgtgagtctgccttatgatgtgtggattcctctcacagagtcaaacctttttttgattcagcaggttggaaacactctttctatagaatctgctaagagacatttcagagtccattgaggcccatggtgaaaaactaaataaaccctgataaacgctagaaagaagctatctgtgaaactgctttgcgatgtttggattcatctcacaaaggtaaacctttctttttatccagcaggtttgaatcactcattttttttttttagaatctacaaaggtaaatttttagaccactgtggcttgtgctgaaaaacagaatatcccccaataaaaacgagaaagaagatatttgtgaaactgctttgtgaagtgtgatttatctcagtgagataacttttctattgattcagcaggttggaaacactctttttgtaaaatctgtgaaggaacatttaaaggccactgaagccaatggtgaaaaaccaagtgtcctcagataaaagctaaaaagagaggttaccataaaactgctttagtttgaatggattcttctaaaagagataaacatttctttgcatttagcaggttggaaacactcttgtaaaatctgtgaatggacatatgggagccctttgaggtctattgttgaaaaactgaattatcaacagataaaaaatagaaagtatctatctgtgaaactgttttgtgaaagaggatttgtcttacaaagttaaacatttcttttgattcagcatgttgatagcactttttatagaatctgtgaaggcacatttggaagtccattgaggcctaaggtgaaaaagtaaataccctttgattaaaaactagaaagaagctatgtgtgaaactgctttgtgatgtgtggattcatcacacagagaaaagactttcctttgattcagcagattggaaacactcttttcatagaatctgcaaagggatatttaagagcccttggaggactgtggtaaaaaactgaacatccccagataaaatttaaaaagaagccaacagtgaaaatgctttgtgatgtgtggattcatctcacagagttaaatctttcttttgactcaactggttggaaacactccatttgtataatctgagaagggacatttgtaatcccattgaggccaatggtgaaaaactgaatatcttcaaataaaacctggaagaagctctctgtgaaactgctttgtgatgtgtggattcatcttacaaattaaccctttttttgattcatcaggttggtaaccttctccttgtagaatctgcaaagggatatttgggagctctttgaggcctaaggtgaaaaacaaaatatccccaattaaaaactataaagaatctatctgtaagactgctttgtgatgtgttcattcatctcacaaagttaaacctttctttttattcagcaggttgtacactctttttgtagaatctgcgaagggacatttgggagcccattgaggcctatgatgaaaaactgaatacccacagataaaaattataaagaagttatgtgtgaatctgctttgtgatgtgtggatccctttaacatatttaaaccttttttttttattcagcaggttggaaacactcattttgtagaatatgcaaagggacacttgggagctcattgaggcctatggtgcaaaactgatgtcttcagataaaaaccagataaaagctatgagtgaatctgctttgttatgtgtggatttctctcacagagtttaacctttcttttatttcagcaaattggaaacattctttttgtagaatctgtgaagggacatttggaagcccactgaggcctacagtgaaagatggaatatctccaggtaaaaactagaaagaaattatttgtgaaactgctttgtgatgtgtgtatttatctcaaagagttaaacctttcttttcattcagtagattgaaaacagtcttcttgtacaatctgcaaagggacatttgggagccctttgaggcttatgtttaaaaaactgaataacaacaaatgaaaactagaatgaagttatctgtgaaatgctttgtgaagtgtggattcatctcacagaattaattaacctttcttttgtttcagcaggttggaaacattgtttttgtagtatctgcgagggactcttgggagcctattgaaggctatcatgaaaaacctaatatccatagataaaaactagaaacaagccatcttgaaactgctttgtgatgtgtggattcatctcccacagttaaaactttttttgattcagcaagttggaaacactttttctagaatctgtgaagggacatttgggagcctctggagacttattttgaaagagggaataatcccagataaaaactagaaagaatctatttataaaactgctttgtgatgtgtggattcatctcacagagttaagactttcttttgattcagcaggtgggaaacactctgaatgtggaatttgcaaagggacttttgggagtccattgaagcctgtggtaaaaaaaaaaaaaaaaaaaaagaatatcctaagataaaaactagcaagaagttatctgtgaaactggtttgtgatgtgtggattcatctcacagagttaaaccttcctattgatttagcagtttggaaaaactctttttgtagactctgcaaagaaacatttgggagccctctgagtctgaaaatgaaaaacctactatctccagataaaaactagaaagaagctatctgtgaaacttctttgtgatgggtagattatctcacaaatttaaacctttcttttgattcagcggattggaaacactattttggagaatctatgaaaagacatttgggaggccatggaggcctataatgaaaaactgaacatcgccagataaaaactggaaagaagctatctgtgaaactgctttgtggtgtctgggatcatctcacagagataaaactttcttttgactcagcaggttggaagcactctttttgtagaatctgtgaagggacgttggaaacctcatggagacctatggtgaataacagaatagccccccaaaaatactagaaagaagctatctgtgaaactgttttatgatgtgtgggttcatctcacaggagttaaacctttcttttgatttagcaggctgaaaacactctttttgtaacctctgtgaagggacatttgggagtccattgagacctatggtgaaaaaccacctatccccagataaaaactagaaagaagctaggtgtgaaactgccttgtgatgtgtggactcatctcacagagttaaacatttcttttgattcagcaggttggaaacactctttttgtagaatcagtgaagggacactcaaaagcccattgaggcctatcatgaaaaaccaatatcccaagatgaaaaatagaaagaagctatccatgattctgctttgtgatgtgtggattcctctcacagagttaaatctttattttgattcagcaggttggaaatattccttttttcttgatggagtctcattctgccaccgaggctggagtgcactggcatgatctcggctcactgcaagctctgcctcccagattcatgccattctcctgcctcagcctcccaaacatctgtgactacaggcacccgccactaaacccagctaatttttttttggtgtttttgtagagatgcggtttcaccatgatagccaggatggtctccatcatctcctgaatttgtgatctgcccacctcagcctcccaaagtgctgggatcgcagacatgagccactgcaactgacagaaatattctttctgtagaatctgtgaaggtatatttgaaaccctgttgaggcctatggtgaaaaactgaatatccccagataaaaactggaaagaagctataggtgaaattgatttatgatgtgtcaattcatctcacagagtaaaagctttcttttgattcagcactttgggaacactctttttgtagaatctgcaaagggacatttttgagcccattgaggccatggtgataaactgaacatcttcagatagaactagaaagaagttatctgtgaaattgctttgtgatgtttggattcatctcaaacagataaatacttccttagattcaggaggttggaaacactttttttgtagaatctgcgagtggacatttggaagagcattgaggcctatggtgaaaaacccgatatccccagatggaaactagaaaggaggtatctgtgaagctgctttgtgatgtgtggattcatctaacaaagttcaacctttcttttgtttcagcaggtgcaaaacactcttttttttagaaactacaatgcaacatttgagagtgttaggggactctagtgaaaaatgaaatatctttagataaaagctagaaacaaactatctgtgaaatggctttgtgatatctagattcatttcacagaggtaaatttttcttttgattcagcaggttggaaacactctgtatgtggaattttcaaaggaatatttgagagaccattgaagcctatggtgaaaaaccaaatagctccagatgaaaactaaaaagacactatttgtgaatctgctttgtgatgtgtgaattcatctcacagagttaatccttccttttgatttagcaggttggaagcactgtttttgtagaatctgtgaagggacatttgggagcccattgaggctgatgttaaaaaatagattatccccagataaaaactcaaaagaagctatctgtgaaattttgtgatgtgtggattcatcacacagagttaaacctttcttttgattcagcaggttgaaaacactttttttgctgaatctgtgaagaaaatttcaggagcctattgaggcctatggtgaaaaactgaatatccccagatatacactagaaagaagctatctgtgaaagtgctttctgatgtgtggaatcatttcacagattagacctttctttttattcaaaaggttggaaacacttacttgtagaatctgcccattgatgcctagggtggataaccaaatttcccaagagaaaaactagaacaaagccatctgtaaaagtcctttgtgatgtgtggactcatctcacaaagatatacctttcttttgatttagcaggttggaaacactctttttgtagaatctgcaaagggacatttggaagcacattgaggccagtgtttaaaaactgagtgtcttcagatacgaatgagaaagaagctgtctgtgaatttttttttttgttgtgtgaattcatctcacatagttaaacgtttcttttgatttagcaagatggaaacactctttttgtagaacctgcaaagggacattttgaagcccattgaggccagtggttaaaaactgaatatcttcagataaaactagaaagaagctatctgtgaagctgctttgggatgtgtggattcatctcacagagttaaagctttcttttggttaagcaggttggaaacactcgttttgtagaatctgtgaagggacattcaagagcccattgaggcctatcatgaaaaactgactatcatcagataacaactagaatgaagatatctgtgattctgttttgtgatgtgtggattcctctcacagagttaaaccttcctttgattgagtgggttgtgtagaatctgtgaagggacatttgtgagcactttgtggccgagggtgaaaaacctaatatacccagagaacttgaaagaagctatctgtgaaactgctttgtgatttgtacatccatctcgcagagttaacacattctttaattcagcaggttggaaacactcgttgtgtagaatcagtgaaaggacattggaaaaaatagtgaagcctatggtgaaaaagtgaatatccccagataaaaaatatagggagttatttgtgaaactgctttgtgaagtatggattcatctcatagtgttaaaactgtcttttgttcagcaggttggaatactctttttgtagaatccacaaagaaacattttggagcccatcgagacctatgataaaaatcgaatatctccagattaaaaactagaaagaaggtatcagtgaaactgctttgtgatgtgtggctatatctcacacagttaaacctctcttttgattcagcgggttggaaacactctgtatgtagaatctgcacagggacatttgggagcccctttgaggcttatggtgaaaaaccaaatatcctcagataaaaactggcaagaaggtatctgtgagactgctttgtgatgtgtggattcatctcagagttaatccttttttctgattcaacatgttggaaacactgcttttgtagaatctgtgaagggacattttggagtccattgaggcctaatgtcaaaaactgatatcaaactgatattttgacctaatgtcaaaaacagacaaaaactagaaagaagctttctgtgaattttctttgtcatgtgtggattcctctgatagagttaaacctttcttttgattcagcaggttgtaaatattctttttgtagaatctgtgaagggtcatttgggagcccatttggggctattttgaataaccgaatatccccagaaaaaaactgaaaagaagttatctgtgaaactgctttgtgttgtatccattcatctcacagagtaaaagctttattttgattcagcaggttagaaacactttttttgtggaatatgtgaagggacatttgggggcccattgaggctgatggtgaaaaccagaatatccccagagaaaaactagaaagaagctatctgtgaaattattttgtgatgattggattcatctcacacagataaatttttccttagattcagcagttggaaagacttttttcatagaatctgtgaaaggacatttgtgagcccattgaggcctaccttgaaaaattgaatattcaaagataaaaactataaagaagctctctgtgaaacttctctgtgatgttggctccatctcacagaattaaatctttcttctcattcagcaggtgagagacactctttttgtagaatctgcgaagggacttttgagagcctaaggaggactatcgtgaaaaaccgaatatctttagacaaaaactgaaacaagctatctgtgaaatggctttgtgatgtgtggagtcatctcacagaggtaaacatttcctttgaatcagcaggttgggacactctgcatgtagaattttggaaaaaatatttgagagaccatcaaggcctatagtgaaaaactgaatattcccagataagaactaaaaagacgctatttgtgaaactgctttttgatgtgtgagttcaacttacagagttaaatctttcttttgatttagcaggttggaaacactctttttgtagaatctgagaagggacatttgggaactgattgaagcctatggtgaataacagaatatccacagataaaaactggaagaaagctatctgtgaaactgctttgtgatgtgtggattcatttcacagattagacgtttcttttgattcaaaatgttggaaacggttttttttgtaaattctgtgaagggacaactgggagcccactaatgcctagggtggaaaaccgaatatccccagagaaaaaccagaaaggagttctctgtgaaactgcattgtgatgtgtggactcatctcacagaatcaaaggtttcttttgacttagcaggttggaaaccctctttttgtagaatctgtgagaagacatttgaaagcctatcatggcctatggtgaagaactgaatatccccagataaaagctacaaagaagctatcagtgaaactgcattgtggtgtgtggaatcaactcacagacttaaactgttgttttgatttaacacgttgcaaacacccttttaaatattaaaaaattaaattaaataaattaaattaaattaataatttaaataaataatttaaaaattaaataaaataaattaaattaaatatttaacaattaaattaaataaatatttaaaagctgattgaggactttaatgatcccagatcaaaactagaaagaatctaactgtgaaactgctttgtgaagtgcacattcatttcacggagttaaacctttcttctgattcagcaggttggataaacccttattgtagtatctgcaaagggacatttgggtgcccattcaggcctatggtgaaaaatcgaatatcccaagataaaacagggaagaatttatttgagaaactactttgtgatttgtagactcatctcactgagttagacctttcttttgattcagcagattggaaacaatctttttgtagaatctgcgaagagatatttgggagcttattgatgccaatggttaaacactgaatatctccagatcaaaactagaaagtagctatctgtgaaactgctttgtgatgtgtggattcatctcacagtgttaaaactttctttttttaagcaggtgggaaaaactatttttgtaaaatctgtgaaaggacatttgagagcctatggaggaatatcatgaaaaactgaatatccctacataaaaactagaaacaagctctctgtgaaactgctttttgatgtgtggattcacctcacagagttaaacctttcttttgattaaccaggttagaaacactctgtatgtagaatttgtgaagggatatttgggaacccattgaggcctatggtgagaaagcaaatatccccagataaaaaactagaaagacactatttgtaaatctgttttgtaatttgtcaattcatctcacagagttaaacctttcttttgattcaggagattggaagcaatttttttgaagaatctgtaaaaaacgtttgggagcccaacaatgcctatggtgataaacagagtatcttcaggtaaaaactagaaagaagctatctgtgaaaccgctgtgtgatgtgcctatttatttcaaagattagaccttgcttttgattcaaaaaattggaaacaccctttttgtagattctacaatggaacaattgggacaccattgaagccttgagaggaaaactgaatatccccagagaaaaaacagaaataagctatctgtgaaagtgctttgtgatgtgtggattcatctcacagagataaacctttcttttgtttcagcacgtggaaaacccttttcttgtggaatctgtgaagggacatttttgagcacgttgaggcctatggtgaaaaatcgagtctccccagatacaaactagaaagaagctatctctgaaattgccctgtgatgtgtggatttatctcacagagttaaacctttcttttgattcagcaggttgaaaacactctgtatgtagaattagtgaggggacattttggaggccattgacgcctattgtgaaaaaccaaatatccccagataaaaactagaaagacaatatttgtgaatctgctttttgatgtgcactttcatctcacagagataaaccttccttttattcagcaggttggaaacactctttttgtagaatctgtgaaggtacattatggagtccatggggcctaaggtgagaaaactgaatatccccagataaaaactgtaaagcagctatatgtgatactgctttgtgatgtgtggattcatctcacagagttaatcctttcttttgattcttcagattggaaacacttctttcatagaatctgtgaaaggacatttgggagtccaaagaggcctatggtgaaataccaaatatccccagagaaaaactagaaagaagctatctgtgaaactgatttgtgatatgtagattcatcttacagagttaaacgtttcttttgattcaacagattggaaacacagttttgtataatctgcaaagagacattggggagcccgttgaggcctatggtgaaaaactgaatgtccccagtgaagaactaggaaggagctatctgttaatttgtaatccgtggattcctgtcacagagttaaacatttcttcagcaggttgaaaacagcctttttgtataatctgtgaaggaatatttgggagctcattgatgtctatggtgaaaaacaatatccctagggaaaaactagaaagaagctatctgtgaatctgctttgtggtgggtggagtcctctcacagagacaaacctttcttttgattcagcaggttggaaacactctttttgtaggctctatgaagggacttttgggagcccattgatgcctatggtgaaaaaccaaatatccccagagaaaaactagaaagaagttatctgtgaaagagctgtgtgagaagtagattagtctcacggagttaacactttctttgattcagcaggttggaaattctccttttgtagaatctgcaaatggacatttgaaatagtagtaaggcctacgaataaaaactgaataatatccccagataaaaactagaggaagctatttgtgaaactgctttgtgatatgtggatttatctcacaaagttaaacttttcttttgttcagcaggttgaaaacactctttttgtagaatctgcatagtgacatttggaacctctttgaggcctatggtgaaaacctgaatagcctcagataaaagctagaaagaagctacctgtaaaactgcttgggtttgactggattcatctgacagaatgaaacctattttttgattcagcaggctggaaacactctttttgtagaatctgctaagaaacatttgaaagccctttgaggcctatggttaaaaaactgaatattgacagataaaaactacagtgaagctatctgtgaaacaactttgtgatgtgtggattcatgtcacagagttaagccttatttttgtgttagcatatgggaaacactctttttgtagaatctgcaaagggacttttgagagcctatggaggcctattgtgaaaaacccaatattgctacataaaaactaaaaacaagctatcagtgaaactgctttggatatatggattcatctcacagagttcagcctttcttttgatttagcaggttgaaaacactctttttctagaatctgtgaggggacgtttgggagcccattgtggcctatggtgaaaaactgaatatctgcagataaaaactagaaagaaactatctgtgaaagtacttagagatgtgaatattcatctcaaaataaacctttcttttgagtcaaatgtttggaaacacctttttgcagaatctgcaaatggacaattgggagccaattgatgccttgggtgaaaaactgggtatccccataaagacactagaaagaagccatttgtgaaactgctttgtgatgtgttggttcgtatgacagagttaaacctttcttttgattcagcaggttggaaacactcttttcatagactctgtgaagggactttgggagcccattgaagactatggtgaaaaaaaaaatctccaaataaaaacgagaaagaagctgtctgtgaaattgctttgtaatgtgtggatacatctcacagagttaaacctttcttttgtttcaggagtttggaaacactctgtatgtagactctgcaaaggaacatttgggagttcattgattcttatggtgaaaaactacatattttcaaaataaaactagaaagaaactatctgtgaagctggtttgtgatgtgtggattcatatcactgagttaaacctttcttttgattcagcagtttgggtgcattatttttgtagactctgcaaagggacatttgagagcttattgaagtctgttgtgaaaaacagaatactctcggataaaaagcagaaaatatctatccgtgaaactgcttagtgatgtgtggattaatctcagggagtaaaagcttccttttgattaaggaggttgtaaacactctttttgtagcatctgtcaagggaaattttgttgcccattgaggcgtatggtgaaaaatggaatatccccatataaaaactagaaagaaacaatctctgaaactgctttttgacctgtggattcatgccactgagtgagttaaacctcttttgatttagcatgtttgaaacactctttttgtaaaatctctgaagggacttgggagccctttgaggccaatggttaaaaactgaatatttccagattaaaaattgaaagaaactatttgtgaaagtgctttgtgatgtgtggattcatctcacagattaatcttttttgatacaaaaggttgaaaacactctttttgtagcatctgtgagggacaattgggaccccattgatgcccagggtgagaaattaaatatcctcaaagaaaaactacaaataagctatctgtggaagggctttgtgatgtgtggatttgtctcacagagttaaacctttgttttgattcagcaggttggaaacacttattctgtagaatctgtgaagggacattttggagcacattgaggcctatagtaaaaaaagaaaaagaaattcccctgataaaaaaaaaaaaaaagctgttagtgaaactgctttgcattgtgtggactcatctgtcagagttgaacttttattttggttcagaaggttggaaacacttgttttgtagaatctgcaaagggatatttgggagctctttgaggccaatgtttaaaaacaaaatacctctaaataaaaactcgaaagaagctaacattgaaactgcttcattatgtatgaattcaccttacagagttaaactttttttttaattgagtaggttgtaaacaattgttttgtagagtctgttaatggacatttggaagcccattgaggcctatcatgaaaaaccgaatatattcagataaaaacttgaaagaagctttcagtgaatctgctttgtgatgcactgattcctctcacagagttaaaactttattttgatttgtcaggttggaaacactcttttcatagaatcttgtgaggaagatttgggggcccattgagacccatggtaaaaagccaaatatccccagataaacactataaagaaggtatctgtgaaacagctttgtgacgtttagattcatctcacagagttaaatctttcttttgattcagcaggttggaaacattctttttgtagtatctgtgaagagacgtttgggagcccagtgaggcctatggtgaaaaaccgattatacccagagaaaaactacaaagaagctgtctgtgaagctgctttgtgatgtatcaatcatctacagagttaaacctttcttttgattcagcaggttggaaacactctttttgtagaatctgtgaagggacatttgggagccctttgaggccaatggtgaaaaactgaatatccccagataacaactagaaagaagctgtctgtgaaagtggtttgagatgtgtggattcatctcagattaaaactttcttttgattcgaatgtttggaaacactctttttgtagaatctgtgaagggacaatgggggcccattaaagcttagggtgaaaaaaacaatatccccagaggaaaattagaaagaagccatctgtgaaactgctttgtgatgtgtggcttcatgtgacagagttaaacctttcttttgattcagcatgttagaaatactctttttgtagaatctgtgaagggatatttgggaacctaatgaggactgtggtgaaaaacaaaatatctccagataaaaatgagaaagaagctatcagttaaactgctttgcaacgtgtgcattcgtctcacatagttaaacctttcttttgtttcagtaggttgcaaacactctttttgtagaatctacagagggacaatttggtgcccattgaggcctatgttgaaaaacaaaatatcctcataaaaaactggtagaaaagtattggtgaaattgctttgtgatgtgtcgattcatctcacagagataaacttttatttaaattcagcaagttggaaaaactttttgtaaaatctgcaaagggacatttgatagcccattgagacctatggtgaaaaactgaatatccccagataacaactagaaagaagcagtatttgaaagtgctttgtgatgtgtgggtttctctcacagaattaaacctttcttttcattccacaagttggaaacactctttttttagaatctatgaatggacaactgggagccaaataatgcttatggtgaaaaattgaatatccccagagaaacagtagaaaaaacctacctgtgaaagtgctttgtgatgtgtgcgttcatctcacagagataaacctttcttttgattcagcaggttggaaactttttttgtagaatctgtgaagaatcgtttaggagcccactgaggcctttggtgaaacactgaataaccccacataaaaactacaaagaagctatctgtgaaactgctttgtgatgtatagattcatctcacagagttaaacctttcttttgattcaacaggttggaaacacactttttatagaatctgcaaaaagacattagggatcccattgaattctatgatgaaaaactgaatatgcccagatagaaactagaaagatgctatctgtgaaactgctttgtgatgtgtgaattcatctccttgagttaaatctttcttttgatttagcaggtttgaaacattcttttgtagaatctgcataggaacactggggagcccattgagaccaatggtgagtaacagaaaaaaaactagaaagaagctgtcagtgaaactgctttgtgatgtgtaaattcatatcaaagagttaaaccttgcttttaattcagaaggttggaaacactctttttatagtggtgatgtgtggattcaccacagaaaaataaacctttctttttattcagcaggttggacacaatctatttgtagaatatgcaaatttacatttaggagcccattgaggcctatggtgaaaaaccaaacatccccagataaaaactagtaagaagttatctgtgaaactgctttgtgatgtgtgcattcatctcacagagttaaacctttctgttgattcagcaggttggaaacactatttttgtagaatctgcaaattgacatttaagagcccactgaggcctatggtgaaaaaccgaatgttcccagaaaaaaactagaaagaatctgtgaaactgcattttgatttgcacattcatctcaccaagttaacatatgctttgattcagcaggttggaaacactgtttttgttgaatctgcgaagggacatttggaagcccattgaggtgtatggtgaaaaatcgaatattgccagataaaagcattctttttgtacaatttgtgaggggtcatttgggagcacattgaggcctgtaatgaaaaaccaaatatccccacataaaaaccagaaagaagctatttgtgaaactgtgctctaatgggtggattcatctcacagagttaaacatttctattgattcagtggcttggaaacacttttttcatagaatctacaaaggagcatttgaaagccctttgttgcatgttttttaaaaatggaatgtctctatttaaaaagtagaaacaagctatctgagaaactgctttgtgatgtgtggattcaactgacagagttaaacatttcttttgattcagcaggttggaagcactctgtagaaacatttgggagcacactgagacctgtggtgaaaatctgattatccccagataaaaattagaaagaagctatctgtggaaatgctttgtgatgtttggattcacctcacacagttaaacctctcttttaattcagtgggttggtaaaaatcttttggtacaatctgcaaattgacatttacaagcctattgaggcctatggtgaaaaaagaatatctcaaataaaaactagaaggaaggtatctgtgtcactgctttgtgatgtgtgggttcatctcacagagttaaacatttcctttgattcagcagttggaaacactctatttgtagaatctgtgaagggacatttgggaacccattgagacctatggtggaaaagtgaatatccccggataaaaactagaaggaatctatctgtgaaactgctttgtgatgtctggattcacctcacagatttaaacttttattttgattcagcaggttggaaacactttagatgtaggatgtgtgaagagatatttgggagcccatggaggcctatggtgaaaaatagaatattcccagaaaaatcctaaaaagaatctctttgtgatactgtttgtgatgtgtgcaatcatctcacttaggtaaactgttctcttgattcagcagattagaaacactctttgtagaatctgttaatggacatttgggagcccattgaggcttatggtgaaaactgaatatccccatataaaaactagaaagaagttatctgtgaacagttttgtgatgtgtggattcatctcacatagttatacctttcttttgattcagcaggttggaaacactctttttgtggaatctttggttggatatttgggagtcctttgaggcataggatgaaaaactgaatatctacagataaaaactaggaagaagctatctgtgaaagtgctttgggatgtgtggattcatctaacagaattaaacctttcttttgatttcacaagttggaaacacttttttggtagaatctgtgaagaaatatttgagacctgattgaggatgatagtgaaaaacagaacatccccacataaaaactagaaagaagtaatctgtacactttcattttggcgtgtggattcaactcacagagttaaaccattcttttgattaagcaggttggaaacactatttctgtagaatctaggaagtgaaatttgtgagcccattgatacttatgttgaaaaacgggatatccacagataagaataagaaagaatctatgtatgaatctgctttgtgttgtgtcaattcatctcacatagttacattttttcttttgtttcagcaggtcagaaacactgttttgtagaatctttgaagggacatttggagcccattgaggcctatggtgaaaaactgaatacccccagatgaaaactagaaaggagctatctgtgaaactgttttgtgatatttggaatcatctcacagagttaacatttcttttccctctgcaggttggaaacactctttttgttgaatatgtgaagggacattttggatcccattgaggactactgtgaaaaacaaaatatccccttataaaaacaagaaagaaggtatctgttcaactgctttgcaatgtgtggattcatctcacagagttaaacctttcttttgattcatctgtttggaaacactcttttagtataattggtgaagggacatttgggagctcattgagacctatgataataagctaaatatccccagataaaaggtagatagaagctctctgtaaaactgccttgtgagatgtggattcatctcacagtactaaacctttctttttattcagcaagttgaaaacactctttttgtaaaatctgcaaagaaacatttgaaagcccttgaggcctatgttgaaaaactgaatatcttcagatgaaaactgcaaagaagatatctgtgaaactgctttctgatgtgtgcattcatctcacagagttaaaccgttcttttgattcggcaggttaaaaacactctttttgtagattctgtgaagggaatttgggagcccattgaggtttatggtgaaaaggtgaatatccccacataaaaagtagaaggaaactctctgtgaaattgctttgtgatgtgtggattcaactcacaaacttcattctttcttttgattcaccaggttggaaacagtctttttgtagaatctgcaaagggacattttggggccctttgaggtctatggtgaaaaatcaaatatccccagataaaaactagaaagaagctatgtgtgaaatagctttgtgatgtgtggattcatctcacagagttaaacttttcttttgatttagcaggttggaagctctctttttgtagaatctgcaaagggacatttgggatcccattgagacctatggtgaaaaaccagacatttccagaaaaaactggaaagaagctatctatgaaacccctgtttgatgcgtgctgttatctcacagatataaacctttcttttcatttggatggttggtaacccactttttgtagaatctctgatggacatatcaggtcccattgaagcctatggaaaaaaatgaacttcttcagataaaaaccagaaataagctatgtgtgaaatggctttgtgatgtgtcaattcatctcacagagttaaacctttctttttattcagcatgttggaaacacttttattgtagactctgcaaagtgacattttggagcccattgaggcctatagtgaaaaacagaacacacccagataaaaattagaaagaagctatctgcgaaatgatttctgatgtgtggatttctcttacagagttaatttattttttgattcagcaggttgcaaatattcttttttaagaatctgtgaagggtaatttaaaagcattgaggctggccaggtgtggtggctcatgcttgtaatcccagcactttgggaggccaaggcaagtggatcacaaggtcaggagatcaagaccctcctggctaacacagtgaagccccatctctacaaaaaatacaaaaaacattagctgagtgtgatggcaggttcctgtagtcccagctacttgggaggctgaagcaggagaaaggcaaggaccaaggaggcagagcttgcagtgagccaagatcatgccacttcactccagcctaggcaacagagcgaggctccatctcaaaaaaaaaaaaagcattgaggcctatggtaaaaaacagaatatccctagataaaaactcaaaagaaactatcagtgaaactgctttgtgattggtggatgcatctcacagagttaaacctttcctttgattcatcatgttagaaacactctttttgtagaatctgtgaagggacattagggagccctcttaggcctatggtgaaaaacggaatctctcctgataaaaaaaaaaagaaagaagctatctgttaaactgctttgtgatgtgtggattcatctcacagagttaacctttatatttattcgacaagttggaaacactctttttgtagaatctgtgaaggaacattttgtagcccattaaggcccatactgaacaacaaaatattgctagataaaaacttgaaagagtctgtcttggaaagtgttttgtgatgtgtgaaataatctctcagatttaaacctttcttttgattcagtaggttggaaacactatttttgtagaatctgcaaaggaacatttgagagatcattgaggcgtatggtcaaaaataaaatatccctacataaaaactaaaaagaaactatctgtgagactgctttgtgatttgtagattcatctcacagagttaaatgtttcttttgattcagcagtttggaaacactctttttgtacacagataaacccttctgataaatctcacacaggtaagtccttctgaagattcagcaggttggaaacacttttctctgtagaatctgtgaagggacatttgggagcccattgaggcctatggtgaaaaagtaaatatcccccagaaagaaattagaaagaagctatctttgaaagtgctttgaggtatatggattcttctcacagattaaacctttattttgttcagtagcttgaaaccactctttttgtagaatctgcaaagggacatttaggagtctatttgggtttaccgtgaaaaacagaatatccctaaataaaacaagaaacaagctatctgtgaaactgttttgtgatgtttgggttcatccctcagagttaaaccattcttttaattcaacaggttggaaacactttgtatgtagaatctgcaataggacatatatgacacctttgtggcctatggtgaaaaatgggatatccccatataaaaactagaaagatgctatttgtgaatctgttttgtgatgtgtggattcatctcacaaagttaaaccttttttatgattcagcaggttggaaacagtctttttgtagaaactgtgaagtgacatttgggagcacaatggggcctatagtgaaaaagtgaataccccagataaaaactggaaataagctatctgtgaaactgctttgtgatgtgtggattcatctcacagagtgaaagctttcttttgatacttcaggtttgaaacacttgttttgtagaatctgcaagggatattatacagcccacagatgcctaaggtgaaaaactgaatattcccaaataaaaactagaaagaagctatgtgtgaaactgctttgtgatgtgtcaattcatctcacagagttaaaactttcttttcattcagcagattggaagcacactttttgaagaatctgtgaagggacatttgaaagcccattgaggactatggtgaaaaactgaatattctgagataaaaactagaaagaagttatctatgaaactgctttgtgatgtttgcattcatctcacataggtaaacccttcttttgattcagcaggttggaaacaatttttttagtatctgtgaagggaattttcaaagtctactgaagcctaacgtgaaaaaatcaaatatctccaaataaaatctcaaaagaagctatctgtgcagtgggtttgtcatatgtacattcacctcacagagttacccgtttcttttgattcaacaggtaggaaacactctttttgtataatctgcaaaaggacatatgggagcccattgatgcctatggtaagaaacagaatatccccagataaacactagaaagaaactgccagtgaaactgttctgtgatgtgtggatttagctcactgagttaaaacattttttgattcagaacgttgcaaagattcatgtatagaatctgcaaatggacatttcagagcctattgaggcctatggtgaaaaacatactatctccagttcaaaacttgaaaggacctatttgtgaaactggtttgtggtctgttgattcatatcacaaagataaaactttcttttgattcagcgggttggaaacactctttttgtagaacccgagaatagacatttgggagtccattgaggcctatgttgaaaaacagatatcccaagataaaaactagaaagaagctatctgtgaatctgctttttatgtataaatccctctcacagacttaaacctttcttttgtttcagcaggttggaaaaactctttttgtagaatatgcaaaaggacatttggcagcctattgaagcttatgatgaaaaaccaaatatcccagataaaaaggtagaaacaagctatctgtgaaactgctttgtgatttatggtttcatattccagagagaagcctttcttttcattgagcatattgttaacactctttatagaatctgcgaaggaacatttgtgagccaaatgaaagctaaggtggaaaaacaaatattgccatataaaaaacctatttgtgaaactagtttgtgatgcgtggattcatctgcaagagttaaatctctcttttgattctgcatatttaaacactctttttgtagaatctgcaaaggggcttttgggagcccattgtggcctctgattaaaagctgaatatccacagataaaaactacaaagaatctatctgtgaaactgctttgtgaagtgtggatttatctcatacagataaagttttaatttgattcagcaggttggaaacactctttttgtagaatatgtaaagggacttaggggagctcattgtgccctgtggtgaaaaaccgaatgtcttcagacaaaaactagaaagaagctatcagtgaaactgctttgtgatgtgtagattcatctcacagtgttaaacatttcttttgattcagcagattggaagcattctgtttttagaatctgaaaagggacattttaaagccaattgacacctataaaaaaatggaatatctccagatacaaactagaaagaagctatctgtgaaactattctgagatgggtggattcatctcactaagataaactttgttttgattcatcaggttggaaacactcttattgtagaatctgtgaactgacatttgaacgcccattcagacctgtggtgaaaaactgaatattcacaggaaaaaactagaagggaagtatctgttaaactgctttgtgatatgtggattctgctcacagtgttaaacttttcttttgactcagtagtttcaaaacagtctttttgtataatctgctaatggaaatttggaagcccactgaggcctatggtgaaagaccaaatatccctagatgaaaactggaaagaggctacctgtgaaactgctttgggatgtgtggattcatctctcagagttaaaccttcttgtgattcaacaggttggaaacacatttctgtagaatctgtgaaaagacaattaggagcccgttgtttcctatggttaaaaaccgaatatccccagaggaaaaaaaataagctatctgtgtaactactttgtgatgtgtggattcatctcacagaactaaacttttcttttgattgagaaggttggaaacacttgttttgtagaatctgcaagaagacatttccgtgcccattgaggccaatggtcaaaacccgaatatccccagttaaaaactagagggaagctacctgtgaaactgctttgtgatgtgttgattcatctcacagagttaaatctttcttttcatttggcaaattggacacactgtttttgtagcatctgcaaagaaacatttgaaagcccactgaggcatatggtgaaaaacaatatccccagataaaaactagaaagaagtggtacgtaaaagtgctttgtgatgtggtgatgtgttgattcttctgacagaatgaaatgtttcttttgattctgcaagatggaaacactatttttgtagaatctgtgaagggtcaatttggagccaattgatgcctttggtaaaaaaatgaatatccccacataaaaactagaatgaagctgtctgtaacagtgctttgtaatgtgtggattcatttcacagagataaccctttcttttgattcagtaggttggaaacactgttattgtacaatctgctaagagacatttggaagcccattgaggcttacagtgaaaaactgaatatccccagataaaaacaagaaagaagctatctatgaaactgctttgtgatgtgtggattcattttacaaagataaacttttcttttgttgcagcaggttggaaactctctttttgtagaatctgtgaagaaacatttgggagcccattgatgtctatggtgaaaacccaaatatccccagataaagactggaaagaacctctctgtgaaactgctctgtgatgtgtggattcacctcacaaagttaaacctttctcttgattcaacaggttggaacacacttttggtagaatctgtgaagggagatttggaggcccaatgagacatatggtgaaaaactgaatatccccaagtgaaaattggaaaaaagctatctgtgaaactgctttgtgatgtgtggattcgtctcacacacttacaccattcttttgattccacaggttggaaacactccttttgtagaatctgcaaagagacagtttggagcgaatttattcctaaggtgaaaaaccaaatatccccattaaaaaaactagaaaaatctatctgtgaatgtgctttgggatttgtgaatttattacacagggataaatttttttttgattcaacatgttgaaaagaatatttttgtaaaatctgtgaagggacatttgaaagcccaatgaggcatatggtgacaacttgaatatccgccgataaaaactagaaagaagctacctgtgaaactgctttgtgacgtgtgggttcatttcatagagttaaacctttcttttgattcaacaagttggaaacactctctttgcagaatctgcaaagggatatttgaaaaccctttgaggcctatggtgaaaaccagaatatccccagatataaactagaagaagctatttgtgaaacttctttgtgatgggtgaattcatgtcacagggttaaacctctctattggttaaggaggtttgcaaaactatttatttttgcaactatttattattgaaagcttgtggtgaaaatccaaatactcccagataaaaacgagaaagaagctatcagtgaaactgctttgtgatatgtggattcatctcgcagagttaaacctttcttttgaataagcaaattggaaactctatttttgtggaatatgtgaagagacatttaagagcccattgaggcctatgttgaaaaacaggttatccctagataaatactagaaagaagctatctgttaagctgttctgtgatgtggggattcatctctcagggttaaacctttctgatgattcagcaggttggaaacacttctcttttagaatctgtaaagagacatttgggaacccattgatacctatggtagaaaacagattttcccaagataaaaactagaaagaagatatctgtgaaactgctttttgatgtgtggattaaccacactaacataaacctttctttagattcagctggttggaaacacaatttttgtagaaactgtgaagggacatttgggagccctttgacacctgtggtgaaaaacagaatgccagcagataaaaactagaaagaagctatctgtgtaactgctctgtgatgtgtgaatttatctatcatagtgaaacctttcttttgattcagaaagttggaatctctgttttggaagaatctgtgaaaggacattttggaacttatggaggcataatgtgaagaactaaatattcccagataaaaactagaaagaagctatttgtgaaactcctttgtgatgtgtggattcatgtcacagagttaaatctttctactcatccagcaggttgttaacactctttctgtagtatctgtgaagggacagttgagggcccacacagacctgtggtgaaaaaaataatattcccagataaaaactaggaaaagctatctgtgaaactgttttgtgaagtgtggattcatctcaaagatttaaacctttcttttgattcagaagattggaaacattcttcttgtagaatctgcaaagggacattttggagccctttgaggccaatggtgaaaaaagaatatccccacataaaaactagaaaaaagacatctgtgaaactactttgtggttcttggactcatctcacaaagataaccgtttcttttgattcagcagattggaaatttttttttgcagaatctgcgaatggacatttggaagcccattgaggcctatggtaaaaaactgattatccccagataaaaactaaaaataagctatttaagaaactgttttgtaatgtgtggattcagcttaccgagataaaccttttttttggttcagcaggttggaaacactcttttgtagaatctgcaaaggaatatttggaagccctttgaggcctatgatgaaaaacagaatatccccagataaaaactaaagagaagctatctgtgaaactgctttgtgctgtgtagattcatctgacagagttaagtctttcttttgattcagtgatttacaagcactttttttgaagtatttgtgaaggtacctttgggagcccattaaggcctatggcattaaaccaaaaatcttcaaataaaagtgagaaagaagctctctgtgaaactgctttgtgatatgtggatttatctcacaaagttaaacctttcatttttttaaatgtgcagtttgaattttaatacatttgtacttatagaagatataaacaatttacaaaatgtagaagagatggaatttacccatcatttaaactaaatttttaataatttgttttttctaatttctttctttcatattccaggtaataaagaactatgctatacggaattccattggcattattatacaaaatcatagtagatacactgaaagataaaattcctacaatcaaatatgctactctctggctaaattttctcagtagcattttgcagaatgtttacatctttcatagaagcaaatttattaaaatttcaaatggcacagtgctttacaggaatcacatttattaacactcctttatttattaaaactaataaataattaaactattatatagaccctcctctgtattacaactacaaaggactataaatcatgctgctttaaagacacatgcacacatatgtttattgtggcactattcacaatagcaaagacttggaaccaacccagatgtccaacaatgatagactggattaagaaaatgtggcacatatacaccatggaatactatgcagccataaaaaataatgagttcatgtcttttgtagggacatggatgaaattggaaaacatcattctcagtaaagtatagcaagaacaaaaaagcaaacaccgcatagtctcactcataggtgagaattgaacaatgagaacacatggacacaggaaggggaacatcacactctggggactgttgtggggtggggagaggggggagggatagcattgggagatatacctaatgctagatgacgagttaatgggtgcagcataccagcatggcacatgtatacatatgtaactaacctgcacattgtgcacatgtaccctaaaacttaaagtataataataataaaaaaagaaaaaagatacctattttctaattgtcaccgctaattaccccaagggcagctgttcgttcatctaccaccagctctcctgtgttctgtactgtccatattttgcctctgataatgcataccactaaaaagaatcagggtacctgggaggaaaattgattccagtgttcaagcaggaaaaaaaatggattggtctggaatatccttttgttgtctgaaatgagctattgcttaaaaaatgtcaggagcagtgctaaaggacagaagagcaaacttaacaaggcttccattggctaagctgcaaagaccatcatcataattgtgataataatcatagtagttaaaacctttccttctattcagcaggttggaaacactgactttgtagagtgttggaagggatattttgatgcccatttagccctatgttaaaaaagtgaatattttcatataaaaccttgaaagaagatgtctgtgaaactgctttgtgatgtgtgcattcatttcacagagtaaacagcttctttttattcagcatgttggaaacactgtttttgtagaatcagcaaggagatatttgggagtccgttgaggccaatggtgaaaaaccaaacatctccagatataaactagaaagaagctatctgtgaaactgctttgcaatgtgtggatttatcttgcagagttaaaccttttttttttttgatccagcagtgttgaaacactctttttgtgaaaactacaaaggagtatttgggaatccattgaaacccatggtggaaaaaatgagtatttccacataaaaaacagaaacaagctttctgtgaaactgctttctgacatgtggatttatctcacagagttgaacctttctttcgattcagaatgttgtaaacactctttttgattcagaagtttggaaacaaatggacatttgggagctttctgaggtctatggttaaaaaaggaatttcccagataaaagttagaaagaagctatctgtgaaacttctttgtgatgtgtggattcacctcacagggttaaacgtttctttttattcagctgtttggaaacacacttcttgtagaatctgtgaagggacatttgagagacaattgaggcctatagtgaaaaatcaaatatccccagataaaatatagaaagaagctatttgtgaaactgctttgtaatgtgtggattcatgtcacagggttaaacctttccattgattcagcacgtttgaaaacttttttttttgtaaaattcaggagaagatatttgaaaacccattgagttctatggtgaaaaaccaaatattcccagaaaaaaccttgaaagaagctatctgtgaaactactgtgtgatgtgtggattcatctcacagagttaaacctttcttttgattcagaaggttgtaaacacacttttcatagaatctgtgaagggaaatttcaaagccattgaggcctatggtgagaaactgaatatctccacttaaaaactaaaaagaagctatctgtgaaactgctttgtcatgtgtggatttatctcacagagttaagccattctttttattcagaaggttggaaaaactcttcttataaaatctgcaaaaagacatttgggaattctttgaggcctatggtaaaaaatggattatctccagattaaaaagtagaaataagctatctgtgaaactgctttgtgacgtctggattcatctcacagtttaaagtttcttttggttcagcatgttggaaacaatctttttttagaatttgggagcctattgagtactatggtgaaaaacagaatatccccagataaaaactagaaagaagttatctgtgaaacctctttgtgatgtgtggattcacgtcacaaatttaaacctttctattgattcagcaggtttcaaacacttttttttaaagaatctttgaaaagacagatgaaagttcattgaggcctatggtgaaaaaccgaatatcccagataaaaacttgaaagaaactatcaatgaaactgctttgtgatgtgtggattcacttcacagaattaaagttttgtttgattcagcaggttggaaactttttttttttttttagaatctatgaaggcacattttagagcccattgatgcctgtggtgaaaaaccgaatatcgtcagataaaaactagaaagaagtaatgtgtgaaactgctttctgaggtgtggattcacaattcaccacgtagactgaaacttttctttccactcagcagattggaaacacttttttttttaagaatttaggagcccattgagcattgtggtgaaaaaaccaaacatctccagataaacactagaaagaagctatctctgaaattcctttgtgatgtgtggattcatctcacagaggaaaacccttttttatttatcagcaggttgggaatattcttaatgcagaatctgcagaagaacatttgtgagaccattgagacttatggtgaaaaattaatatccccagataaaaacgagaaaaaatatgttggtgaaactgctttgtgatgtgtcaattcacctcacagagttaaacctttctttggattcagcatgttagaagcacattttttaacattttgaagcccattttggcctaccattaaaaactgaatatccacagattacagagtagaaagaagatctgtgttaaactgctttggatacgtggatttatctaacagaagtaaagctttcctttaattctgcagtttggaaactctttttttgtagaatctgggaagggatatttgagagtcctttgaaaactatcgagaaaaactgaacattccctgataaaactagaaataatctatacgtgaaaactgctttgagatgagtggattcatctcacagggtttaacctttcttttgattcagcaggttggaaacactttttttgtttaatctgtgaagagacattttggagcccactgggaacccaagtgaaaaaccgaatatccacagataaaagctagaaagaatctatctctgaaacagataaaatatttcttctcccagagttaaacctttcttttgattcagcaggttggaaactctctttttgtagaatctgtgaagggacgtttgggagccaattgagacctatggtgaaaaactgaatatcccatgggaaaaactagaaagtagctatctatgaagctgctttgtgatgtgtggatttatcttacagaaataaagctttctttggattaagcatgttggacacactatcattgtagaatctgcaaagggacatttgtgagtccattgagtcctatggtgaaaaatggaatatccccagttaaaaagcagattaaaccttttttaaattcaacaggttgtaaactctttttgttgattctgtgaaaggatatttgagagtccattgaggcctatggtaaaaaactgaacatccaagataaaaactagaaacaaggtatttgtgaaactgctttgtgatatttggattaatctcccagagagaaaatttcttttctttcaacaagttgttaacactctttttgtagaatctgcgaaaagacattggggatcccattgtggtctattgttaaaaatattatttacagataaaaactagaaagaagctgtctgtgaaactgctttatgatgtgtggattcatcttaaggagtcaaacttttctttttattcagcaggttggaagcattcttagtaggatttgggaagggacattttggggcccctagaggcctatgatgagaaaccaaatatctccagactaaaaactagaaagagactatctgtgaaactgttctaagatgtgtggattcatttcacagagttaaagctgccttttgatttagaaggttgaaaacactctttttgtagaatctgtgaagggacatatagagcccattatatcctagggtggaaagtcaaatatccccagataaaaactagaaagaagctatctttgaaactgctttgtgatgtgtgaattcatctcacagagttaaacctttctgttgattcagcaggttggaaacactctttttgtggaatctgctaaatacatttgggagcccattacagactatggtgaaaaacagtataaccccagtggaaaaactagaaagaagatatctgtgaaactgctctggactgtgtggattaatctaataaagttaaactttcctttgatttatcaggttgtaatcactctttttcgtagaatctgcaaagggacatttggaagcccactgaggcctacagagaaaaactgaatatgtgtactatctatgaaactgctttgtgatgtatggattcatctcacagagttaaacctttcttttgattcagcaggttggaaacactttttgtataatcatcaaagggacatttgaaagcccattgtggcctatggtgaaaaactgaatatccccagataaatactggaaagaagctacctgtgaaactcctttgtgatgtgtgcattcaactcaaatattttaattttttaaaattcaacaggttggaaatggttgataagctttcttttgatgcaccaggttggcaactctattattgtaaaagctgtgaaaggactttcaagaaacccttgtgacccatggtgaaaagccaaatatcccctgataaaaactagatagaacctatctgtaaaactgctttgtgatgtgtggatttgtctcactacattacaccttacttttgatttatcaggttggaaatactctttttgtagaatctgcaaagaaatatttgggagccccttgaggcctgcagagaaaaacagattatccccagaaaaagctagaacaatgctatctgtgaaactgctttgtgatgtgtggattcatctcacagagttaaacttttcttttgattcagcaggttggaaacactctttttgtagaatctaagaagggacatatgaaagcccattgtggcctatggtgaaaaactgaatatcctcagataaaactacaatgaagctacctgtgaaactcctttgtaacgtgtgcattcatctcaacaatttaaaaatttcttttaattcagcaggttggaaacactgtttttgtagactattcaaagaaacatttaaggacccattgtgtcctcctgttacaaaccaaaaatccccagatcaaaacaagaaggaagcaatctttgaaactgctttgtcagttgtgggttcatctacaagagttaaaactttcttttgattcaccaggatggcaactttatttttgtaaaatctgtgaaaggacatttaagaacctttgtggcctatggtgaaaaaccgaatatccccagataaaaactagaaagaagctacctgtgaaattgcttgttgatgtgcacttttatctcaaagatttaaacctttcttttgattcagcaggatggaaatacttttttttgtagaatctgtgaagaaacatttggaagccccttgcggcctaaagtaaaaaacagaatatccccagataaaaactagaaagatgctatctgtgaaactgcttttaaatgtgtggattcatctcacagaggtaaacttttcttttcattcagcaagttggaaccactctttctgtagaatatgtgaagggccttttggagcacattgagacctatgttaaaaaacagaatatccccagataaaaactagaaagaagctatctgtgaaattgcttcatgatgcatggattcatctcaaagaggtaagccttccttttgattgagcagcatggaaacacagtatttgtagaatctgggaaggggcattttgtaacccattttttcatatggtgaaaaaccgaatatctgcaattaaaaaatagaatctatctgtgaaactgcttcatgatgcatgtattcgtctcagagagttaaacctttcttttgattctgcagattggaaacactcttttttgtagcaactgggaagggatctttgagagcccattgacttctatgttgaaaaactgaagaaccccagataaagataagaaagaagctatatatgagactgctttatgatgtgtggattcatctcagggagttaaaactttcttttgattcattcggtttgaaacactcttgttgtataatttatgaagaaacatttgggagcccattgatgactatggtgaaaagccaaataaccccagataaaaactagaaagaagatatctttgaaactgctttgttatgtgagtactcatcttaaagagttaaaactttcttttgattcatccagttggaaatgctctttttgtagaatttgtgaagaaacatttgggaggcaattgaggcctatggtgataaatggaatattccaagatgaaaaactatagaaagaactttccatgatactggtctgggatgtgtggattcatctctcagagtcaatcctttcttttgattcaacaggttggaaacactttttgtaaaatcttggaagggacttttggagttcactgaggcctatggtgaaaaactgaatatccccagataaaaaatagaaacaatgtatctttgaaactgctttgtgatggctgtattcttctcacagagttaaacgtttgttttgatccagcaggttggaaaaactctttttgtagaatctacaaaggggaaattggaagcacattgaggcctataatgaaaaatgggcattcccagatcaaaactagaaggaagctatctgtgaacatgctttgttatgtgtggcttcatctcacaaagttcaacttttattttgattcagcaggttggaaacactattttagtggaatctctgatgggacattttggagcccattgaggcctatggtgaaaaactgaatatagctggatgaaaactcaaaaagaggtgtctgtaaaattactttgagatgtgtggatttatctctccatgttaaaccattctattgattcagcaggttgggaaaacactttctgtaaaatctacaaaaggatatttgagacctgtagtggcctatggtgaaaaactgaatatcccctgacaggaactagaaataaattatctgtgaaactgctttgtgatgtgttgattcttttcactgacttaaacctttttttgattcagaaggttggaaaccattttttgtagaatatgcgaagggacatttgggagcccattgaggcctatgttgataaactgaacatacccagataaaaactagaaagaagctatatttaaactgcttatgaagtgtgcattcatctcacaaattaaacctttcttttgattcagcaggttggaaacactctttacgtggaatctgtgaagagacattagggagcccatggaggcctttggtaaaaatctgaaaaatccaagataaaaactagaaataaagcatctgtgaaacttctttgaaatgtgtggattcctctcacagagttaaacctttcttttgattcagctggttggaatcactctttttgaagaatctgcaaaaggacttttggagcccattgaggaatatggtgaaaaagagaatatccctagataaaaactagaaagaaggtatctgtggaatcctttgagatgtgtggattcatctcaagtagctaaacctttcttttgattcagcagattggaaacacagtttttgtagaatctgggaaggggcattttggagtccattgagtcctgtggtaaaaaactgaatatcctcaattaaaaactagaaagaatctacctgagacagtccttcatgatacgtgaaatcatctcacagagttaaaccattcccttgattcagcaggttggaaacactctttttgtagaatctgggaagggacatttgagagcacattgagttctatggggaaaaacagaatatccccagatcaaaacttgaaagatgctatctgtgtaactgctttatgatgcgtggattcatctcaaagagggaaacctttattttgattcagcaggttggaaacactctttttgtagaatttgcaaagaaacatttgggagccctttgaggactgtggtgaaaaaccaaatatatccagataaaaaactataaagaatctaagtgtgaaactgctttgtgatgggtagatttatctcacagggctaaacatttcttttgatccagcaggttggaaactatcttcttgtagaatctgcaaagggatattttgaagcccattgaggctatggtggaaaaccgaacatccctagataaaaactagaaagaagctatctctgaatctgctttatgatgtgtgcattcatctcacagaattcaacctttattttgattcagcatgttggaaacactctttttgtggaatctgcaaagggacatttgaaagcccattgaggcctatgatgaaaaactgaacatccccagataaaatctagaaagaaggtatctgtgaaactgcttgatgatgtgtgaattcaactcacagggttaaacttttctttggattcagcaggttggagacactctttatatggaacatgcaaaggacaattggaagcccattgaggtctatggtaaaaaactgaaaaatccgagataaaaactagaatgaaggtatctggaaagctgctttgaaatgtgtggattcatctcacagagctaaacatttcttttgattcagtgggtggaaaccactctcattgtagaatctgtgaagggacatttggagtttattgaggtctaagttgaaaaacagaatatccacagagaaaaactaaaagaaaaatatctgtgaaactcttttgtgatgtgacgattcatcccagagagttatccctttttttgactcaaaaggttgaaaccattctagtggttgaattagtgaagggacattttagagaccactgaagcatatggtgaaaaactgagtaaccccaattaaaaactagaaagaatgatctgtgaaactgcttcatgacgtttgtactcatctgacaaagctaaaactttctttggattcagctgattggaaatgctctttttgtagaattttggaagggacatttgagagcccattggattttatgttgaaaaaccgaatatccccagataaaaaccagaaagaagctatctgtgaaactgctgtataagctgtggatttatctcaggtagtgaaaccttccttttcatttggcagcttggaaacacactttttgaagaatctgagaagaaacatttggagtcatttgagaaatatggggaaaatctgaatatcccaagataaaaagaagaaagaagctatctttgaaacagctttgtgatgactggattcatcttaaaaagttaaacctttcttttgattcagccaattggaaagcctcttttttagaatctgcaaagtatcatttgggagccctttgtggcatatggtgataaaccaaatatcccaagacaaaaaattagaaagaagttatctgtgatcttctatgggatttttggattcatctcacagagttaagcttttctttagattcagcgggttggaagggctttttgtagaatctggacagagacttttggagctcaatgaggcctatgatgaaaaactgaatattcctagataaaaactagaaagaagctcttggtgaaactgctttgtaatgtgtgaattcatcttaaagagttaaacctttcttttttattcagcaggttggaaacattgcttttgtggaatctgcaaagggacatttgagagcccattaaagcatatggtgaaaaacagaataccccagaagaaagactagaaagaaaatatctgtgaaactgctctgggatgtgtggattcatctcacaaagttaaactttttttaaaattcatcaggttggaaacaggttggaaactttctttgtagaatctgtgaagggacatttggaacccatttgaggcgtatgttgaaaaactgaatatcccaagataaaaaacagagagaagctatctttgaaactgctttgtgatgtgtggattcatctcagagttaatcctttcttttgattcatcagattggaagcacgctttttgtagaatcagggaagggacatttaagagactaatgatgcctatgaagaaaaacaatatcaacagagaaaaaccaaaaatatgctctctgtgaaagtctttcatgatgtgttggttcatctcacagagttcaacctttcttcttatttagcaggttggaaacattctctttgtgaaatctgagaaaggacatttaggagtgcattgaggcctatggtgaaaaaaagaacatctccagataaaaagtagaaagcagctgtctgtgaaactgctttgtgatttgtagattcatctcacacacttaaacctttcttttgatttagcaggttggaaaagctcttttgtagaatctccaaagggatagtttagcaaagaggcaaatggtaaaaagctgaatatcaccagataaaaactataaagaacattctgtgaaactgcttttttatgtgtggattcaactcacagaattaaaactttcttttgattcagtaggttgggtacactctttttgtagaatctggaaagggacatttgggaagccattaaggtctatggtgaaaaaatgaatatccccagttaaatactagaaagaagatatctgtgaaacttcttcatgagaagagatttatctcacacaggtaaacctttcttttgattcagcaggttggaaacactctttttgtagaattctggaagaaatatttgggagcccattgcatcctatggtgaataattgaatatacccagataaactctagaaagaactttctatgaaactgttttatgatgtgtggattcatctcagagagttaaacctttcagtggattcaccaggttggaaacactttttttgtagaatctgcaaagaaacatttgggagcccattgaggtctatggtgaaaaacaacatatccccagaaaaaaaagtagaaagaagatatctgtgaaactgtttcagatgagtggatttatttcacagagttaaacttttcttttgattcagcaggttggaaacactttttgtagcatctgtgaaaagacatttgagagcccactgtgtcctatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaaccgaatatccccagataaaaactagaaagaagctatctgtgaaacagctttatgatgtgtgcattcatctagagagttaaacctttcttttgaatcagtagcttggaaacaatctttttttagaatctgtgaagaaacatacgtgagcccattggctttgtgatgggtagatttgtcttaaaaagttaaacctttcttttgattcatcaggttggaaacactcattttgtagaacctgtgaagggacatttggtagccttttgaggactatggtgaaaaactgaatatctccagatgaaaaactaaaaagaaactatttgtgaaatggctctgggatgtgtggattcatcacaagaggtaaattttttttgattcagcattttgtaaacactctttttgtaaagtctgggaagaaattttggagaaatttggggcttatggtgaaaaatggaatatctccaaataaaatctagaaagaagctatctgtgaaacaactttgtgatgtgtgaattcatctcacagagttaaaacttacgtttgattgagcaggttggaaacactctttttgttgaatctgtgaagtgacatttgggagcccattgatgtctatggtgaaaactgaatatccccagataaaaactataaaaaagctatctgtgagactgattcatgacgtgtgaattcatcttacagatttaagcctttcttttgattcagcagcttggaaacactttttttgtagaatctatgaagagacatttggggcccattgagacatatggtgaaaatcaaatatccccaaatgaaaactagaaaaaagctatctgtaaaagttctatttcaagtgtggatttagttcacagagttaaactcttactttgtttctgcacattggaaacattctttttgtagaatcagcaaagggacatttaactgcccattcatgcctagggtgaaaaatcaaatatcaggagataaagaccagaaagaagctatttttgaaagtcctttgtgatgtgtggattcatctcagagagttcaacttttcttttttttcagcaggttggaaacattttttgtgtaatctgtgaagggaaatttcagagttcattgaggcctatggtgaaaaagagaacatcccccaataaaaagtagaaagaaacaatctgtgaaactgctttgtgatgtgtggattcatctcacagagtaaaaactttcttttgatttagcaggttggaaaaactctttttgtagtatctgcaaagggacatttgggagcccattgagacctatgttgaaatcacatatcttcagataaaaactagaaagaagttatctttgaaactgctttttgatgtgcagattcatctgacagagttaaacctttcttttcatttagcaggttggatacacacttcttgtagaatctgtgaagggacatatgaaagcccattgtggcctatggtgaaaaactgaatatccccagtttaatactagacagaagctatctgtgaaactgttctgtgatgtgtgaattcatcttacagagttaaacttttcttttgattcagcaggtttgatatactctttttgtacaatctgctaagaaatttttggagacaattaaggcctaaggtgaaaaaccaaatatccccagataaatattagaataaagctatctgtgaaactgcttcgtggtgagtggatttatctcacaaagttcaacgtttcctttgattcagcagattggaaacactttttgtaggatctgtgaagggacatttgggagcacattgagtcttacggtgaaaaaccaaatatctccagataaaaaatagaaagaagttacttgtgaaactgctttataatgtgtggattcatgtcagagaggtatacctttcttttgattcagcaggttaaaaacacttttttttgtagactctgtgaagaaacatttgggaacccattgaggactatggtgaaaagcagaataccccagataaaaactagatagaagctatgtttcaaactgctttatgatttgtggattaatattaaaaagttaaacctctctttacactcagtaggttgaaaacgccctttttttagaatctgcaaagtgacatttgggagccctttgaggcctacggtgaaaaacagaatatccacaaacaaaaaactgaaacgaacatactgtgaaactgctctgtgatgtatggattcacctcacaacgttaaactttacttttgattcagtaaattataaaaaatctttttgtagaatctctgaagggacatttgggagcacattgaggactatggtaaaaaaacaaaatatccccattaaaaaaaactaaaaaaaaaaagattgtgaaactgctttgtgacgtttggaatcatctcacagaattaaaactgttttgattcagcgtgttaaaataactctttgtgtggaatatgtgaagggaattttggagcccattgaggcctatggtgaaaacaatttttttccaattaaaaactcaaaagaatctatctgtgaaacagcttcatgatgcatggatttatctcagaaagttaaaactttcttttgattcagcaggttggaaacactctatttgtagaatttaggaagggacatttgagagcctttcgagttctatggtgaagaacccaatatccccagataaaaactggaaaggtgctatctgtgacactgctttataatatgtggattcatctcagagagttaaacattttctgtgattcaacagattggaaacacactttttgaagagtttttgaagggacactaggaagccatttaggcctatggcgtaaatctgaatactcccagataaaaactaggaagaagctatctgtgaaactgccttgagatgagtgcattcatctcacagagttaaacctttcttttgaatttagtgggatggaaacattctttttgtagaatctgcaaatagacatttgggagcctattaagaactatggtaaaaaactgactatccccagataaaaagtagaaagaatctatcagtgaaacttttatggaatgtgtatattaatcttaaagaattaaacgtttcttttgattcagtagattggaaacactctttttgtagaattcacaaagggacattgggagccctttaaggtctacgatgataaagcaaatatcccaaaatgaaaaacaaaaagaagctatctgtgatacagctctgggatgtgtggattcatctcacagagttaaacgtttcttttgattcagcaggttgaaaacactctttttgtaggatctgggaagggactgatggaactcattgaggcctacagtgaaaaaccaaatatctgcagataaaaaagagaaagaacctacctgtgaaactgttttttgttgagtggattcatctctctgacttaaatttgtcttttgattcaacaggttgcatacactcttattgtaaaatctgtgaagataaatttgtcatcccattgaggcctatggtgaaaaatcagtatccccagttagaaactagaaagaagctatctgtgaaactgctttgtgatgtgtggtttcacctcagagagttaaatgtttcttttcttcagcaggtttgaaatatcctttttgtagaatctatgaaaggacatttagagtgcattgaggcctatgataaaaaatcaaatattcctagataaaaagctagaaagaagctatctctaaaactgctttttttatgtgtgggttaatctcacataattaaacctttctttttatttagaaggtaggaaacaacttttttgtagaatctgtgaaatgacatttgggagacccttgaggcctgcagtggaaatccaaatatcccaagatgaaaacaagaaagatgtgatctgcgaaactgctttgtgatatgtggattcatcttacagaattaaacctttcttttgattcagcaggttggaaatactctatttatagagtctgtgaagaaacacttggagctgatggtggcctatggtgaaaactgaatatccccagataaaaactgcaaagaagctgtctgtgaaactgctttgtgatgtgtggactgatatcataaaatttaacctttcttttgatccagcaggttgaaagcactgtttatgtagtatccttgaaaagacattttggagatcattgaggcctagaaacaagaatgaagctatctgtgaaactgctttgtgatttgtggattcaccccatagagttacccctttcctttggctcagaaggttggaaacacaatttttgtagaatctatggagaagcatttgatagcacattgaagcctatggtgaaaaaccaaatatccccagataaaaactagaaagaatctgtgaaacagctttgtgatgtgtggactcatctcatagagttaagcctttcttttgattcagcaagttgaaacactctttttgcagaatctgcaaagggacatttggaagctcattgaagttatgattaaaaactgaatatccctggatgaaaagttgaaagaagctgtctctgaaactgctttgtgatgtgtggattcatctcacagaagtaaacctttcttttgattcagcagttcagtaacacttttttgtagcatctgccaaagtacgtttgggagtcccttgaggcctttagtgaaaaatcaaatatccttagatagaactagaaagaacatatctgtaaaactgctgcttgatgtgtggattcatctcaaagacttaaaccttcctttaggttcttcaggtaggaaacactgtttttgtacactattcgaagaaagatttgggggcccattgaatcctatgctgaaaaattgaatatcgcaagatcaaaacaaaaaagaagctatctggaaaactgctttgtgatgtgtggttttatctcaaagagttaaacctttcttttgattctgaaggttggcaactctctttttgtaaaatctgtgaaaggacatttgggagccaatggtggcctatagtaaaaaacagattattcccagatgaaaactagaaagatgctatctgtgaaactactttgtgatgtctggattcatcttacagagttaaacatttctattgattcagcaggtagggaacactctttttgtagaatatatgaaagtatatatggagtgctttgaggtctacggcaaaaaattgaatatccacagataaaaactggaaacaagccaactgtaacggctttgcaatgtgtgggttcatatcacagagtaaaaacttacttttgatcagcagtttggaaacactctttttgtagaatctgtgaagggacatttaaaaaaaccactggagtcctacggtgaaaaacagaatatccccagataaaaactagaaacaacctatgtgtgaaactgctttgtgacgtgaaggaatatttgggaggccattgagacctatggtgaaacaccaaatatcctcaaataaaaactagaaagaagctatctgtgaagctgctttgtgatgtgtgcatttatctcaaagacttaactttttttttgattcaacagtttggaaacactctttttatagaatatgtgaagggacatttgggagccccttgagacctaaggtgtaaaatcaaatatctgcagataaaaactggaaacaatttatctgtgaaactgctttgtgatgtgtggattcttttcacagagttaaaacttacttttgatcagcatgttggaaacaccctctttggagaatctgtgaagggacatttgagagcccattgaggcctatggagaaataccgaatatcaacagataaaaactagaaagaaacacctgtgaattgacattgtgatgtgtggattcatctcacagagttaaaccttactttttatcagcaggttgggaatactcttgttgtagaatctgcaaagtaacatttgggaactatttgaggtctatcgtggacaacagaatatcaacagataaaaaatgtaactaagctatctgtgaaacttctttgtgatgtgtgaattcatctcatagagtttaacctttctttgattcagcaggtcggaaacactctgtttgtagaatgtgtgaagggacatttaggagaccaatgggcccatatggtgaaaaactgaatatcctcagatgaaaactagaaaggagctatctctgaaactgcttttttatgcgtgattcacctcaaaaaggtacaactttttttgtttgtttcagcaggttaaaaacactgttttttaaaatcagcaagaagacatttgggagcccattgagacctataatgaaatgcaaaatattcacagataaaaactagaaagaagctctctgtgaaatggctttgtgatgtgtgcattcatgtcaaaatgttaaacctttcttctaattcagcatgttggaaacactcttcttgtaaaatttgcataaggatgtttgaaacccagttgaggcctatggtgaaaaacagaacatccctagacaaaaactagaaagaagctatctgtgaaactgctttgcaatgtgtggattcatctcacagagttaaaccttactttttatcagcaggttgcaaacatcctttttgtaaatcctgccaagaaacatttggagcccattgtggcctatggtaaaaaactgaatattccaagataaaaactagaaaaaagctatctatgaaaatgctttctgatgtgtgaacttatctcatggagttaaatctttctttagattcaggattttggaagaactctttttgtagaatctgagggtgcacaaacaggggacattgaggccaatggtgaaaaacagaatatcttctaataaaaactcgaaagaagctatctgtgaaactgctttgtgatgtatggattcatctaagacagctaaacctttcttttgattcacagcttgaaaacactctttttgtgaagtacgtgaagggacatttggagaccatttaggcttatgttgaaaaaccaaatatcttcagataaaaattaaaataagctatatctgaaattgcatggtgatgtgtggattcatctcatagagttaaacccttcttttgatcagcaagttggaaacactgtttttgtagaacatgtgatgggacatttgggagcccattaatgcctatggtcaaaaatggattatccccagataaaaactagaaagaagctatctgtaaaactgcttcatgatgtgttgattcatctcacagagttaaactgttcttttgatcagcaggtgggaaacagttttttcttagaatctgcaaagggatatttgggagcccactgaggcctagggtgaaaaatcgaataaaccacataaaaactagaaagactctatctgttaaactactttgtgatgtgtggattcctatcacagagttaaaccatttttttttgtttcatgaggttgaaaataatctttttgtaaaaaatgctaagggacatttgtgagcccattgaatcctatggtgaaaaaccgaatatcttcagatagaaactagaaagaagatgtctgtgaaacttctttgagatgtgtggatcatctcccagagttatatgtttcttttggttcagcaggatggaaacactctgtagaatttgcaaaaggacatttgggagcctattgaggcatacagtgaaaaacaaagtatctatggataaaaattagaaaggagctatctgtaaaactgctttgtgatgtgtggattcatctcacagagttaaacctttctattaattcagaaggttggaaacacactttttgtagaatctgagaagggatatgtggagcccaggaggcctatggtgaaaaacgaaatatacccagataaaaactagaaagaagctttctgagaaactgttctgtgatgtgtggattcatctcaaagagttaaacatttttttttgcttcagtaggttggaaacacgttttgtagtatgtgcaaagggacatttgggagctttttgatgtctatagtgaaaaaccaaatatcctcagatagaaactacataaaatctatctgtgaaaccagtttgtgacgtgtggatttatctgacagagttaaacctttcttttgattcagcaggttggaaataatctttttgtaaaatctgcaaagggacataaaagagtgcattgagatctatggtgaaaaacagaatatccccagataaaatctagaaagaagctatctgtgaaaccgatttgtgatgtgtgcattgatttcacagggttaaacctttcttttgattcagaaggtttgtggcactgtttttgtagattctgtgaagaaacatttaagagatatttgaagcctgtggtgaaacacagagtattccaaataaaaacttgaaagaagctatctgtgaaacttttttgtgatgtgtggattcatctaacagagttaaacctttctttgattcagcacattggaaatactctttttgtagaatctgtaaaaggatatttgggagcccattgaggcctatggtaaaaaacagaatatttccagataaaaactagaaaaaagctatctgtgtaactgctttgtgatgtttggattcatctcacagaattaaacatttctttttattcagcaggttgaaaactcttttgtacaatctgtgatgggacatttgagggcccattgacgcctatggtgaaaaactgaatatcctgataaaaactcaaaagaaactatctgtgaaactggtttgtgatgtgtagattcatcacacggagttaaacatttctttttattcagcagatgggaaacacttttttgtagaacctgtgaagggacatttgagagcccattgaggtatacagtgaaaaaccaagtatccccaaataaaaactagaaagaagccatctgtgaaactggtttgtgatgtatgcattcatctaactgaagtaaaccttgcttttgattcagcaggtggcaaacactttttcgtagaaactgtgaagggatatttgagtgcccatagagacctatgatcaacaactgaaatttcccagataaaaaaattgaaggaagctagatgtaaaactgctttgtgatctgtgggttaatctcattccttctgaaactattcgaaacaatagaaaaagagggaatcctccctaattcattttatgaggccagcatcatcctgataccaaagccaggcagagatgcaaacaaaacagagaattttagagcaatatccttgatgaacattgatgcaaaaatcccaataaaatactggcaaactgaatccagcagcacatcaaaaagcttatccaccatgatcaagtgggcttcatctctgggacgcaagcctggttcaatatacgcaaatcaataaacctaatccagcatataaacagaactaaagacaaaaaccccttgattatctcaatagaggcagaaaaggcctttggcaaaattcaacaatgcttcatgctaaaaactctcaataaattaggtattgatgggatgtatctcaaaataataagagctatctatgaaaaacccacagccaatatcatactgaatgggcaaaaactggaagcattccctttgaaaactggcacaagacaaggatgccctctgtcaccactcctattcaacatagtgttggaagttctggccaggacaattaggcaggagaaggaaataaagggtattcaattaggaaaagaggacgtcacattgtccctgtttgcagatgacatgattgtatatctggaaaaccccattgtctcaacccaaaatatccttaagctgataagcaacttcagcaatgtctcaggaaacaaaatcaatgtacacaaatcacaagcattcttatataccaacagacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaatattccatgctcatgggtaggaagaatcaatatcgtgaaaatggccataatgcccaaggtaatttacagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtaccaaaacagagatatagatcaatgggacagaacagagccctcagaaacaatgccacatatctacaactatctgatctttgacaaacctgagaaaaacaagcaatgggaaaaggattccctatttaatatatggtgctgggaaaactggctagccatatgtagaaaactgaaactggatcccttccttacaccttataccaaaattaattcaagatggattaaagatttaaacgttagacctaaaaccataaaaaccctagaagaaaacctaggcaataccattcaggacgtaggcatggacaaggacttcatgtctaaaacaccaaaagcaatggcaacaaaagccaaaattgacaaatgggatctaattaaactaaagagattctgtgcagcaaaagaaactaccatcagagtgaacaggcaacctacaaaatgggagaaaattttcgcaacctagtcatctgacaaagggttaatatcaagaatctacaatgaactcaaacaaatttacaagaaaaaaaaaacaaccccatcaaaaagtgggcaaaggatatgaacaggcacttctgaaaagaagacatttatgcagccaaaaaacacatgaaaaaatgctcaccatcactggccatcagggaaatgcaaatcaaaatcacaatgagataccaaatcacaccagttagaatggcaatcattaaaaagtcaggaaacaacaggtgctggagaggatgtggagaaataggaacacttttacactgttggtgggactgtaaactaattcaaccatggtggaagtcagtgtggcgattcctcaaggatctagagctagaaataacatttgacccagccatcccattactgagtatatacccaagggactataaatcatgctgctataaagaaacatgcacacgtacgtttattgaagcactattcacaatagcaaagacttggaaccaagccaaatgtccaacaatgatagactggattaagaaactgtggcacatatacaccatggaatgctatgcagccataaaaaatgatgagtttatgtcctttatagggacatggatgaagttggaaatcatcattctcagtaaactatcataagaacaaaaaaccaaacactgcatattctcactcataggtgggaattgaacaatgggaacacatggacacaggaaggggaacatcacactctggggactgttgtggggtggggtcaggggggagggatagctttagaagatatacctaatgctaaatgacgagttaatgtgtgcagcacaccagcatggcacatgtatacatatgtaactaacctgcacattgtgcacgtgtaccctaaaacttaaaatataataataaaaaaaaaatctcacagagttaaacctttcctttgatgcaaccggttggaaacactctttttgtagaatatgcaaagggacatttgggagcttagtgagacctatggtgaaaaaatgaaatgtcatcagacaaaactcagaagaagctatctgtaaaactgcttactgatgtatggattcatctcacagagttaaaagtttccttttactaagatggttggaaacatgctttttgtagaatattcaaagggacttttgtgagcccattgaaatccacggcataaaacaaaatatccccagataaaaactagaaagaagctgtctgtgaaactgctttgtgatgtgggaattcatctcaaacagttaaactttttttttgattcagcacattagaaacactcttgttttagaatcagagaagaaataattaagagccctttgaggcctctgttgaaaaaggaattatctccagataaaaattcgaaagatgctatcatcaaagctgctttgtgatgtgtggattcacctcactgatttaaaccttgcttttgattcattaggttggaaaccttttttgttgaacctgagaagaaacatttgggagcctattgaagcttttgggaaaaaacagaatatcttcagataaaaaccagaaagaagttatacattacattaaactgctttttcatgtatgcatttatctcatagagttaaaccttgcttttgattcagcaggttggcaacactctttttgtagaatctgtgaagggatatttgggagcccattgaggcctatggtgaaagacagaatattcccagataaaaactagaagggagctatctgttaaaatgctttttgatgcatggattcatctcacagagttaaaacgtttttttatttagcagtttggaaacactctttttgtagaaactgcaaagggacatttgggagccaagtgaggcctatgctgaaaaacagaatatccccagataaatagtagaaagcagatatctgggaaaatcctttgtgatgtgtggattcattccaaagagtttaacctatcctttgagtcagcaggttggaaacacctttttgtggaatctgtgaaaggacatttgggaacccattaaagtctatggttaaaaacataatatcccctgataaaaatgggaaggaagctacctgtaaaacttctttgtgatgtgtggattcatctcacagtgtgatacatttctgttgactcagtaaggtggaaacactctttctttagaatctgtgaagttacatttgaaagcctatggtggcctaaggtgaaaaacagattatccccagataatatctaaaagtaagctatctgtcaaactactttgtgatgtgtggattcatctcacagagtgaaaccatacttttgattcaacaggttagaaaccctcttcttatagaatctgtgaaaggacttcaggaccccattgaggcctatgctgtggcctatggtcaaaaacagaatatccccagataaaaactagaaagaatctatctgttatacttctttgtgatgtgtggattcatctcacagtgttaaattgttcttttgcttcaggaggttgaaaacactcattttcttagaaaatgcaaagagacatttgtgaatccattgaggtctatggtgaaagacaaaatattcatgaacgaaaactagaaaggagatatctgtaaaactgctttgtgatgtttggattcatctcacagagtttaactttccttttgattcagcaggttggaaacactctttttgtagaatctgcaaagggacatgtgaagcccattgaaacctatggtaacaaatggaatatccccagacaaaaatgagaaagaagctatctgtgaaactgctctgtgatgtgtagattcatctcacagacggaaacgtttcctttgattccacagtttggaaacacgttttgtagtatctgtgaagggacatttgaaagactattgaggtctaaagtggaaaacctaaaatacccagacaaaaactagaaagaatctatatgtgaaaccggtttgctatgtgtggcttcatcacacagaggtaaatctttcttttgattcagcagattggaatcactctttttgtagaatctatgaaggaacatttgggagcccattgagacctttgatgaaatactgaatatctgcagataaaaactagaaagaagctgtctgtgaaattcctttgtgatgtgtggttttatctcacagggttaaacctttcttttgatataggaggttggtaacactgtttttttagattgtgagaagaaacacttgggagcccattgacgcctatggtgaaaaacagaatattcccagataacaacgaggaataagctatctgtgaaactcctttgtgatatatggattcatctcacaaagttaaatttttctttgattcagcaggttggaaacactctttatgtagaatctacctatggacatttgggagcccattgaggcctatggtaaaaatcagaatatccccagataaaaactagaaaaaagctttctgtgaaactgctttatgatgcatagattcatcttacagggataaacctttcttttgattaagcaggttggaaaccttctctttgtagaatctgtgaagggacatgttggtgccatttatgcctatggtgaaaaactgagtatcttcagataaaaactagaaagaagctggctctgaaacttgtttgtgatgtgtgcattcatgtgacagagttaaacctagcttttcattcagcagttggaaaacccttctttgtagaatctacaaagggacatttgagagcccattgaggcctatagtgaagaacttaatgtccccagataaaaaaaaatattgaaggaaactatctgtgaaactgctttgtcatgtgtggattcatctcacagaggtaaaacattcctttcatccagcaggttggaaacacaccttttgtagaatctgcaaagaggcattttggagccctttgagacctatggcaaaaaaccgaatatactcagataaaactagaaagaagctgtctgtgaaactgcttactgatggatggattcatctcagagagttgaaccttttgttttactgagaaggttggaaaaactttttcgtacaatatttgaagggacaattttgaggccatagaggcctatggtaaaaaactaaatatccccatataaaaaatagaaagagtctatctgctttgtgatgtcaggattcctctcaaataattaaatttttcttttcattcagcacattggaaacactctttttgtagaattggcaacaggacaattaagagtccattgaggcctctggtgaaaaagtgaatatccggagataaaaattagaaagaagctatcttttaactgctttgtgatgtgtggattcatctcacagagttaaatcttgcttttgattcatcaggttggaaacagtttttttatagaatctgtgtagggacatatgggagcccagtgaaacctatgggaaaaaacgaatatcttcagatagaaaactagaaagatgctatctgtgaaactgctttgtgatgtgtacagttatctcaaggagttaaaactttctttggattcagcaggttggatacactgtttttgtagagtcttcaaaaagacatttgggggcccactgaggcctaaggtgaaaactagaaataaagtatctgtgaaactgctttgtgatgctttgatacatctcacagagttaaaccttatatttgatcaacaggttgaaaacactctttttgaagtatttgcaaagggacattttaaagcccattgaggcctatgttgaaacattatatccccagataaaaactaaaaagaagctatctgtgaaactgctctgttatatgtgcattcttcccacagaggtaaacctatcttttgattcataaggtcgaaatcaccctttttgtagaatttgcatagggacatcttggtgcccatagaggctttggttaaaatcagagtatctccagataaaaactagaaagaaactatcacagaaagtgctctgtggtgagcagattcatctcacagtgttaaacctttcttttgactgagcaggttggataaactttttctgtagaatctgagagggaatatttggcagcccattgaggctcatggtcacaaaaaatccccagataaaaaggagacaaagatatctgtgaaactgctttgtgatgtatggatttatctcacagaattgaatctttcctttgattcagcaggtgggaaacactctttttgtagaatctatgaaggttatgtgggaggccttttaggcctttggttaaaaccaaatatcccccaataaaaactagaaagacactatctgtaaaactgccttttgatctttggattcatctcacaaatttaaaactttctttcaattcagaaggttgtacactcttttgtagaatctgtgaagaaacatttggaagacagtgaggcatattgtgagaaaacaaatattgccagataaaaattacaaaggagctatctgtgaaattgttttgcaatgtgttgattcatctcacagacttaaataatttttgattcagcaagtttttaacactctttatgtagaatctgtgaaggaacatttgaaagccctttgagtcctatggtgaaaaacagaatatccccagataaaaactagaaagaaggtatcaatgaaactactttgtgatgtgtggattcatctcacagagttaaaccattattttgattcagcaggttggaaacacttttttttgaaaaatctgtgaatgcatattttggagactattgaagcctagggtgaaaaatcaaatatccccagggaaaaactagaaagcagcaatctgtaaaacaactttcttgtgatgtgtgaattcatctcacagatttaaacttttcttttcattcagcaggttggaaacaatctttttgaagattctgtgacaatttgggagctcatactggcttatagtgaaaaacagattaccccacataaaacaagaaagaagctatctctgaaactgctttctggtttgtggactcaactcacagatttaaaacatcccttttactaagcagattggaagcactctttttgtagaatctacatagagacatttgggagcccattgtggcctttagagaaatactgaatatccccagataaaaactacaatgaagctatcagtgaaactgctttgtgatttgtggattcatctcatggtgttaaacattactttgaattcagcacattggaaatactctttctgtagaatctgcaaaagaacatttggagcccatggtggcttactgtgagaaactgaatatccccaggtaaaaactagaaagaagttatctgtttaactgctttgggatatgtggattcatctcacagatgtaaaactttcttttgactcagcatactggaaacactctattcctagatgttgcaaagtgacatttgagagtccattgaggactgtattgaaaatttaaataactgtagataaaagctacaaagaagatatctgtgaaacttgtatgttatgcgtggattcatctcacatacttaaaactttcttctgattcagcacattggaaacacgctattttttgaacctttaaagaaacatttgggagcacatggaaacactctattttttgaatctttaaaggaatatttgggagcacactgaggcctatggtgaaaaaccgaaaatttcctgatcaaaactagaaaaaagctatctgtgaaacagtttcgtatcgtgtggagtcatctcctagagttaaacctttgttttgattcagtaggttataaataccctctttgtagaatctgtgaagtgacatttggagcccattgaggcctacctatgatgaaaaacagaatatccaaagataaaaactagaaagaagcaatatgtgtaactgctttgtgatgtgtggattcatctcacagagttgaaactttcttttgattcaccaggcttgagacactctttttgtaaaatctgtgaaaatatattttggagcccatagaggcctatggtaaaaattggaacatcttcagataaaaactagaaagaacctatcggtataactgctttgtgatgtgtggattcatctcaaatagttcaacctttcttttgattcagcagattggaaacactctttttgagattctacgtagggacacttgggaacccattgaggcctatggtgaaaaacctattatcccaaaataaaaaccagaaagaagctatttgtgaaagtgctatgtaatgttttgattcattgtacagagttaaacttctcatttggcttctcttttgattcagcaagttggagacaattttttgaaaacattctgtcaagggacatattggagcccattgatgactttgatgaaaaactgaatatctccagataaaaactggaaagaaactatctgtaaaactgctttgtgatgtgtggattcatcccacagagttaaagttttctgttgattcagcaggttgggaagactccttttgtagaatctgtaaagggagattttggagcccatgaagacctacagtgaaaaacagaacatccccaggtaataatagaaaaatgttatctgtgaaactgtcttgtgctgtgtagattcatctcagagagttaaacattggttttgaatcagcaagttgtaaacactgtttttgcagtatgtgcaaagggacatttgggaaaacattgatgcctatgttgaaaaaagggaggttcacagaaaaaactacaaataagctatctgtgaaatagctttgttttgagtttattcatttcactgagttaaagctttgtttagattcagcaagttggaaacaccatttttgtagaatctgtgaagggacatttgaaagcccattgaaacctatggtgaaaaatcgaatatcttcagttaaaaactagaaagaaactatttgtgaaactgctttgtgaggtatgggttcatctgagttaaccctttctttagattcagcaagtcagaaaaccctctttttgtagaatctatgaagggacatttggtacctcattgaggtccctcgtgaaaaaagacatatgcagaaaaactagaaagaagctatctgtgaaactgcattttgatctgtggattcatctcccagggaaaacactttcttttgattcggcacatttgaaacagtcactttgtagaacctgtgaagggacatttgggagcccaatgaaacctattgtgaaaaacagaacctccccaaatgaaaactagaaagaagccatcagaaaaactggtttgcattgtgtgcattcgtctcacagagttgaaacattttttttgattcagcaggttggaaacactcttttttgtagaatctgtgaaggaatatttgggagcccatttagacctatgttgaaaaaccaaacatccccagagtaaaactagaaagaagctatacttgaaactgctttttgatgtgtgagttcatctcacagatttaaacctttctttaaattaagcaggttggaaacactattttaaagatatctttaaagggacatttgggagcccattgaggcctagggtgaaaaaaaaatccccagttaaaaactagaaaaaaagctatctgtgaaactgccttgtgatgtgtggattcatccaatagagttaaaagtttcaatgattcagcagattggaaacactctttttgtagaatctgcaaagaaacattttggggcccattgaggcctatggtaaaacatcaaacatacccaaataaaaagtagaaagaaactatctatgaaactgctttgtgatgtttaaattcatctcaaagagttacatcttttttttgattcagtagatgggaaacactctttctgtagaatctgcaaacggatatttgagagctcattgagacctgaggtaaaaaactaaacatccccagataaaaactagaaaaaagcaatctgtgaaactgctttgtgatctgtggattcatctgacacagtttaaattttctattgattcagcatattggaaatcctcttcttgtagaatctttgaagggacatttttgagcacattgaagcctatggtgaaaacccgaacatccccagataaaaactagagagaatgtatctgtgaaactgatttttgatgtgtggattcatctcacaaagctaaacctttcttttgattgagcaggttagaaaccctctttttgtataatctatgatgggatattttggagaccattgaggcctatcgtgaaaaactgaatatccacagacaaaacctagaaagaaggtgtctatgaaatttattgggatgtgtgtattcatctcacagagttaaaagtttcttttgattcagcaggttggaaacagttttttgtagaatctgtgaagggacattttggagcccaatttagcctattttaaaaaaccgaacaccctcagttaaaaactataaagaaactatgtgtgaaactggtttgtcatgtttgcattcatgtcacagagttgaaatattcttttgattcagaagtatggaacactctttttgtagaatctgcatagagatatttgggagcccattgaggtctatggtgaaaaacagaacatcaaagattaaaactgaaaagacactatctttgaaactgctttgtgatgtgtgggatcatctcccatatcaaaaacattcttttgattgaacatgttggaaactccctttttgtagaatctttgatcagacatttgggaactaattgaggtatatggtgaaaaactgaatattcccagataaaaactagaaagaaactctctgtgaaactgcttcatgatgtgtagattcatctcaaaaagttaagcctatcttttgattcagtaggttggaaaaactctttttgtagaatctgagaggggatatttgggagcccattcaggcatatggtgaaaaattgagtaccctccagataaaaactagaaactatctgtgacactgttttgtgatgtgtggagttatctcacagagttatatgtttctttggactcagcagtttgaaaacactctttttatagaatctgcaaggttacattttagagcccattgaggcctttggtgaaaacggactatcccaagatgaaaactagaaagaagctctctgtgaaactgctttgttttgtgtaatcatctaacagagttaaacctttaaacctctgttttgattaaggaggttggaaacacacttttttggagtgtgtacactccagggaacaatttgtagcccattgaagcctattgtgaaaaacctattatcctcagacaaaaactggaaataagctaactgtgaaactgctttgtgatgtgtggattcatttcacaaagttaaaccttacttttgatcagcaggttggaaacactttttgtagaacctgtgaaaggacatttgggagcagttggggcccatggtgaaacaccgaacatccccagataaaaaatggaaagaagtgatctgtgaaacttattgtgatgtgtggattcatctcacagaggtaaaccatacttttgatacagcaggttggaaacatttttttttttgtagaatatgcaatggaacatttgtgagcccattgaagcatatattgaaaaaccaaatatcaacttataaaaccagaagaaaccatctgggaagccgatttttgatgtgtgaaatttcatctcatggagttaaacttttcttttgatttggcaatttggacaaactctttttgtagattctgtgaagaaacatttggcagcccattcaggtctatggtaaaaaagcaaatatcaccagataaaaactggaaaggagctgtctgtgaaactgcttggtgatgtgtggattcatctcactgagttaaactgttcttttgatcagcaggttggaaaatagtcattctgaagaatctttgatggaacaatttggtgctcattgagtcctacactgaaaaaccaaatacccatgaatgaaaactagaaaggggctgtctgtaaaactgctttgtgatgtgtggatttatctcacggagttaaacccttcttttgattcagcagattgaaaacacagcttttgtaaaatctgtgatggtacaagtggagcccatttaagcctattttgaaaaaaggaatatcctcagataaaaactagaaagaagctatctatgaaactggtttgtgatgtgtggacccatttcatagatttaaacctttcttttgattcaacagtttagaaaaacttgttatagaatctgcaaagggatatttggcagcttattgaaacccatggtgaaaaactgaaattcccctagaaagaagtgctctgtgaaatggttctgtcatgtgtggttacaactcacagaattaaaccgttcttttgactcaacaggttgaaaacactctttttgtagaatctgctaaggggcatttaggaggccaaaaaggcttatggtgaaaaaccaaatattttcttataaaaactagaaagaaggtatctgtgaaacagttttctgatatgtgaaatcatctcatggagttaaacttttctttggactcatcagcttggagacactctttttgtagagtatgtgaagggacattttggtgcccattgagtcctatggtgaaaaacagaatatccccagataaaaactagaaaaatctagctgaaaacttgtttgtgatgtgtagattcatctcacagagataaatcttggattttattcagcaagttggaaacactctttgtgtaaaatctgggaagttacattaggcagcccactgagacctaaggtgaaaaacagaatatccatagattaaaaactagaaagaagcgatctgtgaaactgctttttgatgaatggattcatctcacaaaattaaaactttcttttgactcagcaggttggtaacactttttttgtagattctgtgaggaaacatttgggagccctttaaggcctataatgaaagaccgaatatccccagaggaaaactggaaggaagctatctgtgaaactgctttgtgatgtacggaatcatcccacagttaaacctttattttgattcagccagttttaaacactttttgtgtaaaccgtgaagggacatttgggagcccattgaggcctatggtgaaactttgaatatcccctgataaatactagaaaaaagcaatttgtgaaactgctttgtgatgtgtggatttatctcacagagtcaaacgttttttttggtacagcagtttggaaacactctttgtgaagaatctgcaaagggaaatttggggtcccattgaggcctaaggagaaaaaccaaatattcccagacaaaaactagaaagaagctatgtgtgaaagtgctgcatgatgtgtggattaatcttacacagctaaagttttcttttgattcagcaggtttgaaaaacttcttttgtagaatctgtgaagggacagttaagatccctttgaagcctagagtgaaaaacagaacatcccagataaaaagtagaaagaagccatctgtgtaacttgtttgtgatgtgtgaattcatctcacagagttaaaactttgttttgattcagcaggttagaaattatcttttggtagaatctgcaaaggggcaatttgtagccaattgaggcctatggtgaaaaacggaataccccaagataaaaactagcaggaagctatctatgaaactgctttgcaatgtgtggattcacctcacacagttaaatctctcttttcattgagcaggtcagaaactctttttgtagaatctgtgaagacacatttggaatcccattatggcctatggggaaaaacagaatatccccagagaaaaagaagaaagaagctatctgtgaaactgctttgtgatgtgtggattcatatcacagggttaaaactttctgttgactcagcaggtgaaaaacagtctttttgtaacttctgtcttaggacatttgggagccccttgatgcctgtagtgaaacattgaatatccctagataaaaactggaaagaagttatctgtgaaactgctttgtgatgtgtggattcatctcacgtggataaacctttcttttgactcagcaggttggaaacactcttttaatagaatctgtgaaaagacatttggaacccaatgaggcttatgaggaatgaaaaactgaatatccccagatagaaactagaaagaagttatctgtgaaactggattttgtagggtggacttatctcacagagttaagcctttgtcttgactcagcaggttggaaacactctttttgtagcatctgagaagccacatttgagagcccatttttgcctactgtgaaaatccaaatgatcccagataaaaactagaaagaagctatctgtggaacagttttatgaagtgtggattcatctcacacagttaacacattcttttgattcagcaggctggaaacagtcttttgtggaatctgtggatggacatttgaaatccctttgagacctgtagagaaaacggaatactctcagagaaaaagtagaaagaagctatatgtgaaactgctttgttttacgttgattcatttcaaagagataaacctttctttttattcagaagttggaaacagtctttttgtagggtccgcaaggagacattttggagcccattgaggcttgtagtgaaaaatcaaatatccccagataaaagctagaaagacgctgtctgtgaaacgactttgtgatgtgtggattcatctcacagagttaaacctttcttttgattcagctggttggaaacacttctttttttagaatctgcaaaaggatatttgggagcccactgaagcccttgttgaaaaactgaatattgccaaatgaaaattagaaagaaactatctacaaaactcgtttgtgttgtgttggttcaccacactgagttaactctttctcttgattaacatgttggaaacactctttttttagaatctgcaaagggacattgcagagcccattgaagcctgcagtgaaaaacgaaatatccccagataaaaactagaaagaggaaatctgtaaaattgctttgtgatgtgtggattcatctcacagagttaaactttacttttgatcagcatgttggaaacagtctttctgaagaatctgcaaagagacatttgggagcccattgtggcctttggtgaaaaacagaatatccccagaaaaaaagtagaaaaaactatctgtgaaactgctttgtgatatgtggattcatctcacagagttaaactttaattcagcagtttctaaactctgcttttgtagaatatttgaaaaggcatttgggagcccattgaggcataaggtgaaaaatatcccaagacaaaaaaagaaagaaatatctgtaaaactgctttgtgatgtgtggattcatctcagagagttatatattacttttgactcagcaggctggaaacactctttaagcactctttttgtagaatctgtgaagggacatttgggagaacattgtagcctatggtgaaaaactgaatatcctagataaaaacaagaaagaatttctccatgaaagtactttctgatgtgtgcagtcatctcacagaggtaagcttaaattttctttctgcagaccggtaacacgtctttgtaggatctgcgaagggacattgtttaggccattgagacctgtggtggaaaacagaatatccccaactataaactagaaagaagctaatagtgaaattccttcatgatgtttggattcatctcacaaagataatcctttcttttcattcattcgcttttaagctctctttttgtaggatatgttaagggacattttagagcttattgaggcctatagtaaaaaacaaaatatcctcaaataaaaactagaaagaagctatgtgtgaaagtgcttgatgatgtgtgcattcatctcagagagttaaacctttttttttattcagtgggttggaaacactctttttgtaaaacctgcaacagtatatctgggagagcattgaggcctaaggtgaaaaactgaatatacaaagataaaaactagaaggaagttatctgtgaaactgattttttgaagtttggattcatctcatgaaattaaacctttcatttggttcagcaggttggaaacactctctttatagaaactactaagggacatttgaaagcctattgaggcctatggtgaaaaatagaatatctccagataaaaacgagaaagaagttatctgtgaatctgctttgtgatgtgtgcattcatctcatagcgataaaagtttcttttgatttgactggttggaaacactcttttcatagaatctgggaagaaacatttttgggccccttaaggactatggtgaaaaatcaaatatccccaggtaaaacaaaaaagcagttatctttgaaagtcctttgtgatgtgtggattcatctcacagagttaagtctttcttttgatttagcagttaggaaacactttttttgtagaatctgcaaagtgacatttgggagcccattgaggactatggtgagaaaccaaatatccacagattaaaacgagtaagaagctgtctgcgaatgtgcattgtgatgtctggattcatcacacagggatacaactttcttaaatgcagtaggttttatgcactctttttttagagtctgcgtagggacagttgggaaccctttgaagactgtggtgaaaaaacatatattcccagataaaaactagaagcaagctatctacaaaactgctttgtgatttgtagattcatcttacagtgttaaacctttcttttgaatctgtacattggaaaaactttctttgtagaagctgcaaagagacatttaaggggcaattgaggcctatggtgaaaaactaattatccccagaaaaaaaaaagaaaaaagttatctgtgaaactgctttgtaatgtatggattcaagtcacaaggttaaacagatcttttgattcagctggttacaaacactctttttgtagaatctgtgaagagacatttggtagtgcattgaggcctatggtaaaaaaaaagattatccccctaaagaaaacagaaaaaagctatttgtgaaactgcttattgaggtgtagattcatctcacagagttaaacctttcttctgattcagaagattggaaacactctttttgtggaatttgtgaggggacatttgagagcccgtggaggcctagggtaaaaaattgaatatcccaagataaaaacgagaaagaatctatctgtgaaagtgctttgtaatgtgtggattcatctcccagggttaaacatttcttttgattcagcatgttggagacactcttttgtagaaactgcaaagggaaatttgagagcccattgagtcctatggtgaaaaactgaatatcccaacataaaaactagaaagaagatagctaagatagtgctttgtaatgtgtggatttatcccactgagataaacctttcttttgattcagtgtgttttaagcactctttttgtagcatgtgcaaagggacatttgaaagctgattgggtcatataatgaaaaacagaatatgcccaaataaaaactagaaagaaactgtctgtgacactgctttgtgatgggtggattcatttcacagagttaaaactttcgtcttattcagctgtttggaaacgctccttttgtagaatgtgttaaaggacatttgagagcccatggaggcctaaggtgaaaaactgagtatacccaaatgaaaaccctctgtgaatcttctttgtgatgtgtgtattcatctcagagggttacacctttcttttgattcagcaggttggaaacactctttttgtataatctgcaaagggacatttgggagctgattgaggcctagtataaaaaactgtatatgcctagataaaaactagaaagaagctatcagtgaacctgcttaatgatgtgtggattcatctaacagcgctaaaagtttattttggttaagtaggttggaaaaactttttgtagaatctgtgaagagaaatttaaaagccctttgagggctatggtgaaaaactgaatatcctgagataaaaacaagaaagaagctatctgtgaaactgcttttggatgtgtggattcatccaaaagagttaaacacttcttcgtgttcagcacgttggaaacacacttcttggagaatctacaaatggacatttctaagaccattgtagcctaaggtgaaaaaccgagtatcttcagataaaaactagatataaggtatctgtgaaactactttgtcatgtgtggattcatttcacagagttaaagctttcttttgattcagcaggaagaaaacacactttttgtagaatctgcaaagggacatttggaagcccattgaggcctacgatgagaaacacattatccagaggtaaaactggaaagaagttatctgtgaaactgcttttgatgtgtggatacatctcacagagttcaatgtttcttttgaatcaggaagttggaaacactctttttccagaatcttcaaagaaacacttgggagcccatagaggcatagggtgaaaaatcgaatatcccagtatgcaaactagaaagaagctatctgcgagactgcttttgatgtgcagatacatatcacagagttaaacctttacttttgattcagcaggttggaaacattctttttgtagaatctgcaaaaagacatttcagaacctattgaaggctatggtgaaaaacagaatatccacaggtaaaaattggaaagaaactatctgtaaaagtgctttgtgatgtgtggattcatctcagagttaaacgtttgttttgattcagcaggttggaagctcttcttttgtagaatctgcgaagggaaatttggcaacccagagagtcttgtggtgaacaatagaatatacccaaataaaaattagaaagaagctatctgtgaatctgctttgtgatgtgtggattcatctcacagggttaaacatttcttttgattcactagtttggaaatcctctttttgtagaatctgtgaagggacatttgggagcacattgaggcctaaggtacaaaaccaagtatcccagtatacaaagtagaaaaaagctatctgttaaactgatttctgatttgtggattcatttcatagagttaaattttttttttatttaacatgttggaagctgtctttttatggaatctgcaataagacatttggaagctatttgaggcctaccataaaaaccagatatccccagataaaaactagaaacaagctatcatttaaactgttttgtgatgtgtcatttcatctcacagagttaaaacctttcttttgatttggcaagttggaaacacttttgttgtggaatgtgagaagagacattttgaagcccattgaggctgataatgaaaagcagaaaatctccatataaaaacttgaaagacactatctgtgaaactgctttgtgatgtgtggattcaagttacagatttaaaaccgtcttttgattcagctggttggaaacactcttatgtagaatctgtgaagagacattttggggccctttgaggcctatggtgaaaaccagaatatcctcagataattactagaaagaatctatctgtgaaaatgctttgctatgtgtatattcatctcaaagagttaaaactttcttttgattcagtatgttggaatactttttttgtagaatctgtgaaggaaaattttggagcttattaagtcctatggtgaaaaacggaatattcccagataaaaactagaaagaagctatctgtgaaactgctttgtgatgtgtggactcatctcacagagtaaaacctttcttttgattcagcagtttggaaatactctttttgtagaatctccaaagggacatttgagagcccatgatggtctaccataaaaatctgaggatcctcagataaaaactagaaagaagctatctgtgacactgcttgtgatgtgtggattcatcacaaagagttaaaagtttttttgattcagcaggttggaatcactctttttgtagaaactgtgaagagacatttgagagccctttgaggcacacgctgaaaaaccaattatccaaagataaaaactagaaagaaactatttgtgaaactgcttggtgatgtgtctattcatctcaaaatttaaacatatattttgattcagcaggtttgaaacactgttttgttagaatccgtgaagggatattagagagcccatttaggcatatagtgaaaaaccaaatatcctcacataaaaactagaaagaaactttctgtgaaattgctttgtgatgtgtggattcatctcagagagtttaaccttttttgattcagcagtttggaaacacttctattgtagaatctgtgaagagacattttggagttcatttaggcctatggtaaaaaacaaatatcaccagaaaaaagaactagaaataagctatcggtgaaactgccctgtaattagtggatttgtctcatggagtaaaacttttcacttgattcagtagtttggaaacaccctttttgtagaatatccaaaggaacattttggagcccactgaggtttatgttgaaaaacctaatatccccagataaaaactataaagaagcaaactgtgaagctgctttgtggtgtgtgaattcatctcacagttaaacttttcttttgattcagcatgttggaaacaccctttttgtagaaagtctgaagagacattagggagccctttgatgcctatgttgaaaaaccgattatccaaagataaaaaggagagataagctatgctttgtgatacgtagattcatctcagaaagttaaacctttcttttgatttagcacgtttgaaacactctttttgtaaaatgtgcaaagggacattttggagtccattgaggcctatggtgaaaaacagaatatccctacatgaaaactagaaagaagctatatgtgaaagtgctttgtgatgtgtgcattcatctcacacagttaaaccttgcttttgattcagtaggttggaaacacaccttttgtggaatccatgaagggacatttgtgaactgttggactatggtgaaaaaatgattattcccagataaaaactagaaagaagctacctggtaaactgctttgtgatgtgtagattcatcacacagagatgaacctttcctttgattcagcaggttggaaacacttcttttgtagaatctatgaagggatctttgggagtttattgaggcctatagtgaaaaacagaatatcaccacataaaagctagaaagaagctctctgtcaaattgctttgtgatgtgtggattcatttcatagagttaaacctttgttttcattcagcagtttgaaaacactctttttgtagaagctgcaaaggaacatttgggagcctattgaaatctttggtgaaaaaccgaatattcccagataaaaactagaaggaagctatctatgaagtgctttgtgatgtgtggattcatctcacagtgttaaacctttcttttgactcaacaggtggtaacactcttttgtgaaaatctgcaaaaagacattttggagcactttgagccttatggagaaaaacagagaatccacagataaaaactagaaagaagctgtttgtgaaagtgttttgtgatgtgtggattcatttcacagagttaaaccattcttttgattcggaatgttggaaacactctttttgtagaatctgtgaggggacatttaagagcattcaggactacaatgaaaaactaaatatccccagaaaaactagaaagatgctatttgtgaaagtgctttgtgattggtggatttatctctctgttaaacattttttttattcagcaggtgggaaactgtctttttgtagaatctccagggggacatttttgagcccattgtggactatggtgaaaaactgaatatttcaagataaaaactagaaagaaactatctgtgaaactgctttgtgatttgtggatttgtatcacagagttaaacctttcttttgatacagtaggttggaaacactctttttgtagactctgtgaacagacacttgagagcccattgaggcctatggtgaaaaacaaattgtccctagataaatactagaaagaacctacctgtaaaattgccttctgatgtgtggattcatctcaaagggttaaactttacttttgactcaccaggtggtagcactctttttttttggaatctgcgaagggtcattttggagcccttttgagccctatgttgaaaaacagaaagtcctcagataaaacctagagagaaacttcctgtgaaactgctttttgatatattgattcatcacacagagataaaactttcttttgattcagcaggttggtaacacttctcttgtagaatctgtgaataaacaatttggagcccatttatgcttatggtgaatgaccatttattgccagataaaaagtagaaagaagctatctgtaaaactgctttgtaaggtgtagatttatctcacagagttaaacttttcttttccatcagcaggttgaaaacacagcttttgtagaaactgcaaagggacatttggaatcccactgagtcctatgggtggaaaattgtaaatcaccccataaaatctagaaagaagctttttgtgaaactgctttgtgatgtttggattcaggtcacagagttaaacctttgttttgattcagcaggttgtaaacactcttttagagaatctgcaaagcaacatttttaacccattgaaacctatggtgaaaaactgaacgtccccagataaaaactagaaagaaactacctgagaaactgcttgtgatgtgtggatttttctcacaaagttaaacctttcttttgattcagcatgttggaaacactttttttgtagaatctgcaaagggacattttggtggccattgaggcctatggtgaaaaacagaataaccccagataaaaatgagaaagaagcaatctgtgaaactgctttgtgatgtttggatttatctcacagcattgaacctatcttttgattcagcaggttggaaacacctttttgtagaatctgtaaagggacatttgggattccattgatgcctaaggtgaaaaaccgaatgtccccagagaaaaacatgaaagaagctgtctgagaatctgctttgtgacgtgtagactcctctcacagagtcacccctttctttcaattcagcagtttggaaacactctttttgtagactctgcaaacggtaattttggaacccgagtttgcctatggccaaacaccaaatattcccagataaaaactagaaagaagctctttgtaaaactgctttgtgatgtgtagattcatctcaaaaagttaaaccctccttttcattcagcaggttaaaaacactatttttgtagaatctgcaaagaaacatagtgggcttattgaggcctgtgttgcaaaactgaatatccccagagaaaaacaagaaagaagctacttgtgaaactgccctgtgaagtgtagatgaatctcacagagttaatcctttcttttaattcagcaggtttgaaacaccctggttgtagattctgcaaagagttatttgagagcattttgaggcctatgataaaaaaccgaatatccctagatgaaaactagaagaaagctctttgaaaaactgctatgttttgtgtagattcatctgaaagagttaaacatttcttttctttcagcaggttggaaacactctttttgtagaatctgcaagggacatttgggcacctgttgatgagtatggtgaaaaaccatatgtccccaaataaaaactagaaagaagctatttgtgaaactgctttgggttgtgttgatttatctaacagacttgaacctttcttttgattcagcaggttggaaacattctttttgtggaatcagcaaagagacatttgggagcccattgtggcctatggtgaaaaaaaaaagaatatccccagataaaaactagaaagaagctatctgtgaaattcctttgtaatgagtagatttatcttacagagttaaacttatgttttgattcatcaggttggaaacactctttttgtagaatctgcacagggacttctggagaccatttaaacctatggtgaaaaccgtatatacccagattaaaagtaaaaagaagttatatgtgaaacttctttgtgatatgtgggttcatctcaaggtgttaaacatttcttttgattcagctggttggaaaccctctttttgtagaatctgcaaagggacacattaaccccccttgagaactatggtgaaaaacagaatatcctcagataaaaactagaaagaagccatctgtgaaactgctttgtgataagtggattcatctcacagagttaagcctttctgttgattcagcagtttggaaactgtttgtgtagcatctgcaaagggacttttggaagccaaatgaggccaatggtgaaaaaaagaatatccccagaaaaaaactagaaagaagctgtctgtgaaactgctttgtgatgtttgaattcaccacacagagctgaaactttcttttgattcagcagattggaaacactctttttgtagatctgcaaagggacatttaggagccaactgaagccagtgttgaaaaactggacatccccaaataaaaactagaaaaaagtgatctgttgaactgctttgagatgtgtggattcatctcatagcattaaacatttcttttgattcagcaaattgaaaacactctttttgtagaatctgcaaaggaaatttgggagcccattggggcctatggtgaaaacaccataaaaactacaaaaaatttatctgtgaaaaatgctttgtgatgtgatgattcatctcacagagttaaacttttcttttgatttaaaaggacggaaacacttttttttaaataaaatctgtgtagggatatttggcagcccattgagggctatcatgaaaatcaaaaatccccagataaaaactagaaaaaagctattggtgaaactgctttgtggtgtgtggattcatctcacagagtaaaatttttcttttgattcagcatgttggaaacactcttttttttttataacaaaaccagaaagtt
